US008362322B2

(12) United States Patent
Apuya et al.

(10) Patent No.: US 8,362,322 B2
(45) Date of Patent: Jan. 29, 2013

(54) MODULATING LIGNIN IN PLANTS

(75) Inventors: Nestor Apuya, Culver City, CA (US);
Steven Craig Bobzin, Malibu, CA (US);
Jack Okamuro, Oak Park, CA (US); Ke Zhang, Wilmington, DE (US)

(73) Assignee: Ceres, Inc., Thousand Oaks, CA (US)

( * ) Notice: Subject to any disclaimer, the term of this patent is extended or adjusted under 35 U.S.C. 154(b) by 270 days.

(21) Appl. No.: 12/446,929

(22) PCT Filed: Oct. 26, 2007

(86) PCT No.: PCT/US2007/022737
§ 371 (c)(1),
(2), (4) Date: Nov. 5, 2009

(87) PCT Pub. No.: WO2008/069878
PCT Pub. Date: Jun. 12, 2008

(65) Prior Publication Data
US 2010/0058498 A1 Mar. 4, 2010

Related U.S. Application Data

(60) Provisional application No. 60/855,108, filed on Oct. 27, 2006.

(51) Int. Cl.
*A01H 5/00* (2006.01)
*C12N 15/63* (2006.01)
*C12N 15/82* (2006.01)
(52) U.S. Cl. .......... 800/284; 800/298; 435/468; 435/419
(58) Field of Classification Search ........................ None
See application file for complete search history.

(56) References Cited

U.S. PATENT DOCUMENTS

| | | | |
|---|---|---|---|
| 4,987,071 A | 1/1991 | Cech et al. | |
| 5,034,323 A | 7/1991 | Jorgensen et al. | |
| 5,204,253 A | 4/1993 | Sanford et al. | |
| 5,231,020 A | 7/1993 | Jorgensen et al. | |
| 5,254,678 A | 10/1993 | Haseloff et al. | |
| 5,538,880 A | 7/1996 | Lundquist et al. | |
| 5,728,570 A | 3/1998 | Matern et al. | |
| 6,013,863 A | 1/2000 | Lundquist et al. | |
| 6,114,609 A | 9/2000 | Beck et al. | |
| 6,326,527 B1 | 12/2001 | Kirihara et al. | |
| 6,329,571 B1 | 12/2001 | Hiei | |
| 6,423,885 B1 | 7/2002 | Waterhouse et al. | |
| 6,441,272 B1 | 8/2002 | Ye | |
| 6,452,067 B1 | 9/2002 | Bedbrook et al. | |
| 6,573,099 B2 | 6/2003 | Graham | |
| 6,610,908 B1* | 8/2003 | Chapple ........................ | 800/287 |
| 6,753,139 B1 | 6/2004 | Baulcombe et al. | |
| 6,777,588 B2 | 8/2004 | Waterhouse et al. | |
| 6,831,208 B1 | 12/2004 | Chiang et al. | |
| 7,173,121 B2 | 2/2007 | Fang | |
| 7,214,789 B2 | 5/2007 | Pennell | |
| 7,312,376 B2 | 12/2007 | Apuya et al. | |
| 7,378,571 B2 | 5/2008 | Apuya | |
| 7,402,667 B2 | 7/2008 | Cook et al. | |
| 7,429,692 B2 | 9/2008 | Dang | |
| 7,598,367 B2 | 10/2009 | Cook et al. | |
| 2002/0124281 A1* | 9/2002 | C. Chiang et al. ............ | 800/278 |
| 2003/0175783 A1 | 9/2003 | Waterhouse et al. | |
| 2003/0175965 A1 | 9/2003 | Lowe et al. | |
| 2003/0180945 A1 | 9/2003 | Wang et al. | |
| 2004/0214330 A1 | 10/2004 | Waterhouse et al. | |
| 2006/0010516 A1 | 1/2006 | Forster | |
| 2006/0021083 A1 | 1/2006 | Cook | |
| 2006/0041952 A1 | 2/2006 | Cook | |
| 2006/0150283 A1* | 7/2006 | Alexandrov et al. ......... | 800/288 |
| 2006/0260004 A1 | 11/2006 | Fang et al. | |
| 2007/0006335 A1 | 1/2007 | Cook | |

FOREIGN PATENT DOCUMENTS

| | | |
|---|---|---|
| WO | 97/01952 | 1/1997 |
| WO | 98/36083 | 8/1998 |
| WO | 98/53083 | 11/1998 |
| WO | 99/32619 | 7/1999 |
| WO | 02/46449 | 6/2002 |
| WO | 2005/098007 | 10/2005 |
| WO | 2006/005023 | 1/2006 |
| WO | 2006/034479 | 3/2006 |

OTHER PUBLICATIONS

Guo et al, PNAS 2004 (101)25,9205-9210.*
Hu et al (PNAS, Plant Biology 95(1998) 5411).*
Xu et al BMC Bioinformatics 2009, 10(Suppl 11):S3.*
U.S. Appl. No. 60/505,689, filed Sep. 23, 2003, Cook.
U.S. Appl. No. 60/518,075, filed Nov. 6, 2003, Pennell.
U.S. Appl. No. 60/544,771, filed Feb. 13, 2004, Cook.
U.S. Appl. No. 60/558,869, filed Apr. 1, 2004, Cook.
U.S. Appl. No. 60/583,609, filed Jun. 30, 2004, Alexandrov.
U.S. Appl. No. 60/583,691, filed Jun. 30, 2004, Alexandrov.
U.S. Appl. No. 60/612,8891, filed Sep. 23, 2004, Kwok.
U.S. Appl. No. 60/637,140, filed Dec. 16, 2004, Feldman.
U.S. Appl. No. 60/757,544, filed Jan. 9, 2006, Dang.
U.S. Appl. No. 60/776,307, filed Feb. 24, 2006, Kwok.
Bateman et al., "Pfam 3.1: 1313 multiple alignments and profile HMMs match the majority of proteins" *Nucl. Acids Res.*, 1999, 27(1):260-262.
Battle et al., "Global carbon sinks and their variability inferred from atmospheric $O_2$ and delta$^{13}$C," *Science*, 2000, 287: 2467-2470.
Bernardez et al., "Adsorption of *Clostridium thermocellum* cellulases onto pretreated mixed hardwood, avicel and lignin," *Biotechnol Bioeng.*, 1993, 42(7): 899-907.
Bustos et al., "Regulation of b-glucuronidase expression in transgenic tobacco plants by an A/T-rich, cis-acting sequence found upstream of a French bean b-phaseolin gene" *Plant Cell*, 1989, 839-854.
Cerdan et al., "A 146 by fragment of the tobacco *Lhcb 1\*2* promoter confers very-low-fluence, low-fluence and high-irradiance responses of phytochrom to a minimal CaMV 35S promoter" *Plant Mol. Biol.*, 1997, 33:245-255.
Chang and Yang, "Enhancement of plant formation from embryo cultures of *Taxus mairei* using suitable culture medium and PCP," *Bot. Bull. Acad. Sin.*, 1996, 37: 35-40.

(Continued)

*Primary Examiner* — Anne Kubelik
*Assistant Examiner* — Lee A Visone
(74) *Attorney, Agent, or Firm* — Fish & Richardson P.C.

(57) ABSTRACT

Materials and methods for modulating (e.g., increasing or decreasing) lignin content in plants are disclosed. For example, nucleic acids encoding lignin-modulating polypeptides are disclosed as well as methods for using such nucleic acids to generate transgenic plants having a modulated lignin content.

19 Claims, 122 Drawing Sheets

OTHER PUBLICATIONS

Chenna et al., "Multiple sequence alignment with the Clustal series of programs" *Nucleic Acids Res.*, 2003, 31(13):3497-3500

Chernoglazov et al., "Adsorption of high-purity endo-1, 4-betta-glucanases from *Trichoderma reesei* on components of lignocellulosic materials: cellulose, lignin and xylan," *Enzyme Microbiol Technol.*, 1988, 10(8): 503-507.

Conkling et al. "Isolation of transcriptionally regulated root-specific genes from tobacco" *Plant Physiol.*, 1990, 93:1203-1211.

Dai et al., "RF2b, a rice bZIP transcription activator, interacts with RF2a and is involved in symptom development of rice tungro disease" *Proc. Natl. Acad. Sci. USA*, 2004, 101(2):687-692.

de Feyter and Gaudron, Methods in Molecular Biology, vol. 74, Chapter 43, "Expressing Ribozymes in Plants", Edited by Turner, P.C., *Humana Press Inc.*, Totowa, NJ, 1997, pp. 403-415.

Do et al., "ProbCons: Probabilistic consistency-based multiple sequence alignment," *Genome Res.*, 2005, 15(2): 330-340.

Durbin et al., "3-Markov chains and hidden Markov models; 4-Pairwise alignment using HMMS; 5-Profile HMMs for sequence families" In Biological Sequence Analysis: Probabilistic Models of Proteins and Nucleic Acids, (Cambridge University Press, Cambridge, UK, 1998, pp. 47-134.

Fejes et al., "A 268 by upstream sequence mediates the circadian clock-regulated transcription of the wheat Cab-1 gene in transgenic plants," *Plant Mol. Biol.*, 1990, 15:921-932.

Fromm et al., "An octopine synthase enhancer element directs tissue-specific expression and binds ASF-1, a factor from tobacco nuclear extracts" *The Plant Cell*, 1989, 1:977-984.

GenBank Accession No. AJ010324, dated Jan. 7, 2000.

GenBank Accession No. CAB65335, dated Jan. 7, 2000.

Green et al., "Binding site requirements for pea nuclear protein factor GT-1 correlate with sequences required for light-dependent transcriptional activation of the *rbcS-3A* gene" *EMBO J.*, 1988, 7:4035-4044

Hatfield and Fukushima., "Can lignin be accurately measured?" *Crop Sci*, 2005, 45:832-839.

Hyrup et al., Peptide nucleic acids (PNA): synthesis, properties and potential applications *Bioorgan. Med. Chem.*, 1996, 4:5-23.

Jordano et al., "A sunflower helianthinin gene upstream sequence ensemble contains an enhancer and sites of nuclear protein interaction," *Plant Cell*, 1989, 1:855-866.

Keller and Baumgartner, "Vascular-specific expression of the bean GRP 1.8 gene is negatively regulated," *Plant Cell*, 1991, 3(10):1051-1061.

Lam et al., "Site-specific mutations in alter in vitro factor binding and change promoter expression pattern in transgenic plants" *Proc. Natl. Acad. Sci. USA*, 1989, 86:7890-7894.

Luan et al., "A rice *cab* gene promoter contains separate *cis*-acting elements that regulate expression in dicot and monocot plants," *The Plant Cell*, 1992, 4:971-981.

Lubberstedt et al., "Promoters from genes for plastid proteins possess regions with different sensitivities toward red and blue light," *Plant Physiol.*, 1994, 104:997-1006.

Matsuoka et al., "Tissue-specific light-regulated expression directed by the promoter of a C4 gene, maize pyruvate, orthophosphate dikinase, in a C3 plant, rice" *Proc. Natl. Acad. Sci. USA*, 1993, 90:9586-9590.

Medberry et al., "The Commelina yellow mottle virus promoter is a strong promoter in vascular and reproductive tissues" *Plant Cell*, 1992, 4(2):185-192.

Meier et al., "Elicitor-inducible and constitutive in vivo DNA footprints indicate novel *cis*-acting elements in the promoter of a parsley gene encoding pathogenesis-related protein 1" *Plant Cell*, 1991, 3:309-316.

Dence, "The determination of lignin," in Lin, S.Y., Dence, C.W., eds., Methods in Lignin Chemistry, Springer-Verlag, Berlin Germany, 1992, pp. 33-61.

Mooney et al., "The effect of initial pore volume and lignin content on the enzymatic hydrolysis of softwoods," *Bioresour Technol*, 1998, 64: 113-119.

Niu et al., "Factors affecting *Agrobacerium turnefaciens*-mediated transformation of peppermint," *Plant Cell Rep.*, 2000, 19:304-310.

Perriman et al., "Effective ribozyme delivery in plant cells" *Proc. Natl. Acad. Sci. USA*, 1995, 92(13):6175-6179.

Pfam web cite (describing concensus sequences for a variety of protein motifs and domains at sanger.ac.uk/Pham and genome.wustl.edu.Pfan, 2006.

Rivera et al, "Genomic evidence for two functionally distinct gene classes," *Proc. Natl. Acad. Sci. USA.*, 1998, 95:6239-6244.

Sonnhammer et al., "Pfam: A comprehensive database of protein domain families based on seed alignments," *Proteins*, 1997, 28:405-420.

Sonnhammer et al., "Pfam: multiple sequence alignments and HMM-profiles of protein domains," *Nucl. Acids Res.*, 1998, 26:320-322.

Summerton and Weller, "Morpholino antisense oligomers: design, preparation, and properties" *Antisense Nucleic Acid Drug Dev.*, 1997, 7:187-195.

Truernit et al., "The promoter of the *Arabidopsis thaliana* SUC2 sucrose-H$^+$ symporter gene directs expression of β-glucuronidase to the phloem: Evidence for phloem loading and unloading by SUC2" *Planta*. 1995, 196:564-570.

Vinzant et al., "Simultaneous saccharification and fermentation of pretreated hardwoods," *Appl. Biochem and Biotechnol*, 1997, 62: 99-104.

Yamamoto et al., "The promoter of a pine photosynthetic gene allows expression of a βglucuronidase reporter gene in transgenic rice plants in a light-independent but tissue-specific manner" *Plant Cell Physiol.*, 1994, 35:773-778.

Yan et al., "New construct approaches for efficient gene silencing in plants," *Plant Physiology*, 2006, 141: 1508-1518.

Zhang et al., "DNA sequences that activate isocitrate lyase gene expression during late embryogenesis and during postgerminative growth," *Plant Physiology*, 1996, 110:1069-1079.

Authorized Officer Kee-Yeun Kim, International Search Report and Written Opinion from PCT/US07/022737, mailed Jun. 10, 2008, 14 pages.

Authorized Officer Athina Nickitas-Etienne, International Preliminary Report on Patentability from PCT/US07/022737, mailed May 7, 2009, 8 pages.

\* cited by examiner

| SEQ-ID | | | | |
|---|---|---|---|---|
| SEQ-ID-130-GI-50944321 | LTNH NRQVS | RLLRAPSKNE | GPFVF NPYLL | VGALALLASG | DAASAFI DPS | 377 |
| SEQ-ID-132-CLONE-1784441 | LTNHSNGQVS | KLLRAPSMNE | GSFF LSPYLL | VGALSLLASG | DAASAFI DPS | 380 |
| SEQ-ID-126-ANNOT-837136 | LT KHKDGRES | LLRFP PSKDG | DK-I QPSFL | I PLLAI LATG | DAASG L DPS | 380 |
| SEQ-ID-129-ANNOT-1491360 | LTNHENGRES | LLLRAP VKDG | KPS LLNPSVL | VPLLAVL VAG | DAASG I DPS | 397 |

| SEQ-ID-130-GI-50944321 | LPRFITATAF | ASAAVGTA N | QVI LPEI RKL | PQKTVDI I AV | RQQLLSQYDM | 427 |
| SEQ-ID-132-CLONE-1784441 | LPRLITATAI | ASAAI GTTLN | QVVLPEI QKL | PQKA MDI VAV | RQQLLSQYDI | 430 |
| SEQ-ID-126-ANNOT-837136 | LPQLLSVA TV | T SLAI GATVN | SFVLPKLNQL | PERTVDVV G | KQQLLSQYDV | 430 |
| SEQ-ID-129-ANNOT-1491360 | LPQFL VAAI | SSL G VGATLN | T L VFPG LNQL | PQKSVD ATA I | KQKLLSQYDL | 447 |

| SEQ-ID-130-GI-50944321 | LQTRLKDLKQ | LSEKEVWMLA | RM SQLENKI L | AVGEPSYRAR | RGRVKRVL ES | 477 |
| SEQ-ID-132-CLONE-1784441 | LQSRLKELKQ | LAQKEVWMLT | RMCQLDNKI L | AVGEPSYRAR | RGRVKRVRES | 480 |
| SEQ-ID-126-ANNOT-837136 | LQ RRI RDLKE | AV EKEVWMLA | RMCQLENKI L | AVGEPAYRT R | RTRVKKVRES | 480 |
| SEQ-ID-129-ANNOT-1491360 | LQSRI KELKE | AAEKEVWMLA | RMCQLENKI F | AVGEPSYRAR | RT RVKRVRE G | 497 |

| SEQ-ID-130-GI-50944321 | LESTLLAKI E | LMESYAKLCS | MI EI EVEMDS | DVI VAEAASS | AERI SEQI QQ | 527 |
| SEQ-ID-132-CLONE-1784441 | LESTL SARI E | LMESYAKLCS | MI EI EMDS | DVLAAEV ASS | AERI SEQI QQ | 530 |
| SEQ-ID-126-ANNOT-837136 | LENSI KGKI D | LI DSYARI SS | MI EI EVEMDS | DVLAAEA VNN | TEN AQQI QQ | 530 |
| SEQ-ID-129-ANNOT-1491360 | LENSLEGRI E | LI DSYARI SS | MI EI EVEMDS | DVLAAEA L SN | VES I AEQI QQ | 547 |

| SEQ-ID-130-GI-50944321 | MEI DSLEEQ | WRI QAEANDE | AERLLNSDSS | ETF SAE HV-- | --------- | 565 |
| SEQ-ID-132-CLONE-1784441 | MEI DSLEEQ | WRI QAEANDE | AERLLSSDSS | EI L PA CHM-- | --------- | 568 |
| SEQ-ID-126-ANNOT-837136 | MELENLEEK | WKI QAEANDE | AERLLSSQPF | P T SS L HS VAL | --------- | 559 |
| SEQ-ID-129-ANNOT-1491360 | MELENLEER | WRLQAEANDE | AERLLSSQPP | PT SS L HS VAL | VYLMPLLEKI | 597 |

| SEQ-ID-130-GI-50944321 | --------- | --------- | 565 |
| SEQ-ID-132-CLONE-1784441 | --------- | --------- | 568 |
| SEQ-ID-126-ANNOT-837136 | --------- | --------- | 559 |
| SEQ-ID-129-ANNOT-1491360 | CSVESSKKQA | GNTLA | 612 |

| SEQ-ID | | | | | | | |
|---|---|---|---|---|---|---|---|
| SEQ-ID-147-CLONE-917285 | LTVYSRYLAG | ACAR- | APAVPPSELL | ALARSQADYI | GRNPLRLSY | 421 |
| SEQ-ID-145-CLONE-1791482 | LSAYSGYLSS | AGEA-RCPD | GGAASAGEVF | AMARSQVDYV | LGSNPRGMSY | 445 |
| SEQ-ID-143-CLONE-350091 | LSAYSDYLAE | AGVRTVSCAG | GETVAAREVA | ALARAQVDYV | LGTNPRGVSY | 425 |
| SEQ-ID-146-GI-50912563 | LAMADYLGD | DADGAVSCAG | GETAGAGEVA | ALARAQVDYV | LGTNPRGLSY | 417 |
| SEQ-ID-136-ANNOT-860676 | LTVYSDHLRK | SNTD-LECHE | G-LVTPDEML | GFAKSQIDYI | LGSNPMETSY | 414 |
| SEQ-ID-140-ANNOT-1472020 | LTVYSDFLLN | SNQK-KCHG | G-SVDHEEIL | GFAKSQVDYI | LGSNPMNMSY | 416 |
| SEQ-ID-138-CLONE-1948359 | LTVYSDFLRN | SNQH-LRCPT | G-TIDPEEIL | SFAKSQVDYI | LGSNPMNMSY | 372 |
| SEQ-ID-142-CLONE-1924069 | LTIYSEFLQD | SNQN-LACPA | G-TVDHEEIL | SFAKSQVDYV | LGSNPMNMSY | 434 |
| SEQ-ID-147-CLONE-917285 | MVGYGPRFPA | QVHHRAASI V | SHKANRFI G | CMQGFDHWYA | SKRPNPNVLT | 471 |
| SEQ-ID-145-CLONE-1791482 | LVGYGARFPA | RVHHRAASI V | PYKHSKEFI G | CAQGFDHDWFV | RRGANPNVVV | 495 |
| SEQ-ID-143-CLONE-350091 | LVGYGPKYPS | RVHHRAASI V | PYKHSKEFI G | CTQGFDHWFG | RRSSNPNVLV | 475 |
| SEQ-ID-146-GI-50912563 | VGYGPKYP- | RVHHRGASI V | SFKEHKGFI G | CTQGFDHWFG | RRSSNPNVLV | 467 |
| SEQ-ID-136-ANNOT-860676 | LVGYGPKYPA | RVHHRGASI A | SYRENKGFI G | CTQGYDNWYG | RSEPNPSVLV | 464 |
| SEQ-ID-140-ANNOT-1472020 | LVGYGSKYPL | RVHHRGASI V | SYRENKGFI G | CTQGYDNWYG | REEPNPNVLV | 466 |
| SEQ-ID-138-CLONE-1948359 | LVGYGSKYPA | RVHHRGSSI V | SYRENKGFI G | CTQGYDNWYS | RVEPNPNVLV | 422 |
| SEQ-ID-142-CLONE-1924069 | LVGYGSKYPT | KVHHRGSSI V | SYRENKGFI G | CTQGYDHWYN | RAEVNPNVLV | 484 |
| SEQ-ID-147-CLONE-917285 | GAI VGGPNCR | DEFRDDRANY | VQTEACTYNT | APMVAVFARL | HNLSAAEE-E | 520 |
| SEQ-ID-145-CLONE-1791482 | CAI VGGPDRR | DRFRDHRENY | MQTEACTYNT | APMVGMFAM | NRLARDEAVA | 545 |
| SEQ-ID-143-CLONE-350091 | CAI VGGPDRR | DRFRDNRENY | MQTEACTYNT | APMVGMFAKL | HRLARQER-E | 524 |
| SEQ-ID-146-GI-50912563 | CAI VGGPDRR | DRFRDNRENY | MQTEACTYNT | APMVGMFAKL | NRMARQER-E | 516 |
| SEQ-ID-136-ANNOT-860676 | GALVGGPDCQ | DDFDDRRGNY | VQTEACTYNT | APLVCVFARL | TELEEQKL-E | 513 |
| SEQ-ID-140-ANNOT-1472020 | CALVGGPDCR | DNFTDQRSNY | MQTEACTYNT | APLVGVFAKL | LQMEGQKSHD | 516 |
| SEQ-ID-138-CLONE-1948359 | CALVGGPDCR | DNFMDQRDNY | MQTEACTYNT | APLVGVFARL | LQLE------ | 467 |
| SEQ-ID-142-CLONE-1924069 | GAVVGGPDSE | DNFWDQRDNY | MQTEACTYNT | APLVGVTAKL | LQLE------ | 529 |
| SEQ-ID-147-CLONE-917285 | EGCRPGTA-- | -LGLSANCR | 536 |
| SEQ-ID-145-CLONE-1791482 | AADPSVN--- | ------R | 554 |
| SEQ-ID-143-CLONE-350091 | QGPTPAPAPA | PVTSAAADV | 543 |
| SEQ-ID-146-GI-50912563 | QEEVAAPA-- | --RSTAADV | 531 |
| SEQ-ID-136-ANNOT-860676 | EEDVSLVA-- | ------TYKR | 525 |
| SEQ-ID-140-ANNOT-1472020 | NHNQPLVA-- | ------SY-- | 526 |
| SEQ-ID-138-CLONE-1948359 | NLEVELVA-- | ------SY-- | 477 |
| SEQ-ID-142-CLONE-1924069 | NHELELFA-- | ------SY-- | 539 |

| SEQ ID | Sequence | # |
|---|---|---|
| SEQ·ID·158·CLONE·1790816 | GPMLQP-TVN ASSQ------- ---------- ---------- ---------- | 205 |
| SEQ·ID·153·CLONE·477792 | GPILQST TVN ASSL------- ---------- ---------- ---------- | 206 |
| SEQ·ID·149·ANNOT·860791 | GPILQQNTVN ASSL------- ---------- ---------- ---------- | 207 |
| SEQ·ID·319·CLONE·1930079 | GKILAM-DIN RENYEIGLPI IEKAGLAHKI VFREGPALPV LDQMIEDGKY | 148 |
| SEQ·ID·155·GI·51091033 | GPLLQP-TVN ASST------- ---------- ---------- ---------- | 208 |
| SEQ·ID·154·CLONE·677424 | GPLMQS-TVN TSSN------- ---------- ---------- ---------- | 209 |
| SEQ·ID·156·CLONE·336720 | GPLMQP-TVN LSSE------- ---------- ---------- ---------- | 206 |

| SEQ ID | Sequence | # |
|---|---|---|
| SEQ·ID·158·CLONE·1790816 | ---FLIYLLK GGPDKVRNKL WHIVDVRDLA EALLLVEGA GASGRHICAP | 252 |
| SEQ·ID·153·CLONE·477792 | ---ALLKLLK GI-VNSMENKI RWIVDVRDVA DALLLAYEKL EAEGRYICHS | 252 |
| SEQ·ID·149·ANNOT·860791 | ---VLLKLLK EGFETRDNQF RHLVDVRDVA QALLLVYEKA EAEGRYICTS | 254 |
| SEQ·ID·319·CLONE·1930079 | HGSYDFIFVD ADKDNYLNYH KRLIDLVKVG ---GLIGYDNT LWNGSV---- | 192 |
| SEQ·ID·155·GI·51091033 | ---VILGCLK GI-DCEVKIKL RNFVDVRDVA DALLLYETP GVSGRYICSS | 254 |
| SEQ·ID·154·CLONE·677424 | ---LLNYLK GERDTVENKL RNVVDVRDVA DALLLAYENP EASGRYICSS | 256 |
| SEQ·ID·156·CLONE·336720 | ---MILKYFK D-LETVENVL SNMVDIRDVA DALLLTYEKP EASGRYICSS | 252 |

| SEQ ID | Sequence | # |
|---|---|---|
| SEQ·ID·158·CLONE·1790816 | HVVSVRELLD SLKSNYPDYP CIAKESVFDR DHPAPMSSEK LKKLGWSFRP | 302 |
| SEQ·ID·153·CLONE·477792 | HTIKTRDMLE KLKSIYPNYK YPAK--YIDA DDYISFSSEK LQRLGWKYRS | 300 |
| SEQ·ID·149·ANNOT·860791 | HTVKEEIVVE KLKSFYPHYN YPKK--YIDA EDRVKVSSEK LQKLGWTYRP | 302 |
| SEQ·ID·319·CLONE·1930079 | ---------- ---------- ---------- ---------- -VAP------ | 195 |
| SEQ·ID·155·GI·51091033 | HARRMPHIITD LLKSMYPGYK FIADK--FVEV SDEPQFNSGK LEKLGWKIKP | 302 |
| SEQ·ID·154·CLONE·677424 | KPVKVSDMIS VLKTLYPMYT YPKN--FTEV EENTIYSSEK LQKLGWTFRP | 304 |
| SEQ·ID·156·CLONE·336720 | HAIKISDMIN ILKTMYPSYP YPKN--FVED DVNSVYSSEK LQKLGWSFKP | 300 |

| SEQ ID | Sequence | # |
|---|---|---|
| SEQ·ID·158·CLONE·1790816 | LEETIADAIG FCQRA----- ---------- ---------- --GFLGDAD | 324 |
| SEQ·ID·153·CLONE·477792 | LEETLVDSVE SYREA----- ---------- ---------- --CHLQ--- | 319 |
| SEQ·ID·149·ANNOT·860791 | LEETLVDSVE SYRKA----- ---------- ---------- --KLV---- | 320 |
| SEQ·ID·319·CLONE·1930079 | PDAPLRKYMR YYRDFVLELN KALAADSRIE ICQLPVGDGI TLCRR---- | 241 |
| SEQ·ID·155·GI·51091033 | FEETLRDSVE SYRAA----- ---------- ---------- --GVL---- | 320 |
| SEQ·ID·154·CLONE·677424 | LEKTLGDSVE SYKAS----- ---------- ---------- --GVL---- | 322 |
| SEQ·ID·156·CLONE·336720 | IEESLRDTVE SYKAF----- ---------- ---------- --GIL---- | 318 |

| SEQ ID | Sequence | Pos |
|---|---|---|
| SEQ-ID-172-GI-92894433 | ------MCS PSST RLNLDG | 43 |
| SEQ-ID-171-GI-34905954 | MSSSSSPPAA SAAA RLDLDG | 50 |
| SEQ-ID-168-GI-85718018 | ------MA G--- RVDLDG | 39 |
| SEQ-ID-169-GI-37379419 | ------MA GG-- RVDLDG | 40 |
| SEQ-ID-165-ANNOT-1541782 | ------MA SSVV RLDLDG | 42 |
| SEQ-ID-160-LOCUS-AT1G08200 | ------MA NGAD RLDLDG | 42 |
| SEQ-ID-162-CLONE-1459647 | ------MA NGAV RLDLDG | 42 |

| SEQ ID | Sequence | Pos |
|---|---|---|
| | NPI KPITICI GAGGFIGSH LCEKLMQTP | |
| | NPI APLTICM GAGGFIGSH LCEKLMAETA | |
| | NPI KPMTICM GAGGFIGSH LCEKLMSETP | |
| | NVI KPMKICM GAGGFIGSH LCEKLMNETP | |
| | KPI NPLTICM GAGGFIGSH LCEKILNETQ | |
| | KPI KPMTICM GAGGFIGSH LCEKLMETP | |
| | KPI KPLTICM GAGGFIGSH LCEKLLETP | |

| SEQ ID | Sequence | Pos |
|---|---|---|
| SEQ-ID-172-GI-92894433 | HKVLALDVYS DKLKHLLEPD TLPWNNRI DY HSLNI KNDSR LEGLIKIADL | 93 |
| SEQ-ID-171-GI-34905954 | HVVADVVYC DKIRHLVDPA PPHLHGRI SF HRLNI KNDSR LEGLI KMADL | 100 |
| SEQ-ID-168-GI-85718018 | HTLAVDVYS DKI KHLLEPT SLPWNGRIQF HRI NI KNDSR LEGLI KMADL | 89 |
| SEQ-ID-169-GI-37379419 | HTVLAVDVYS DKI KHLLEPA DLPWTGRIQF HRI NI KNDSR LEGLI KMADL | 90 |
| SEQ-ID-165-ANNOT-1541782 | HKI LALDVYN DKI KHLLEPD SLPWAGRIQF HRI NI KHDSR LEGLI KMSDL | 92 |
| SEQ-ID-160-LOCUS-AT1G08200 | HKVLALDVYN DKI KHLLEPD TVQAGRI QF HRI NI KHDSR LEGLI KMADL | 92 |
| SEQ-ID-162-CLONE-1459647 | HKVLALDVYN DKI KHLLEPD SEWAERI QF HRI NI KHDSR LEGLVKMADL | 92 |

| SEQ ID | Sequence | Pos |
|---|---|---|
| SEQ-ID-172-GI-92894433 | V----- ------ YSNFVDAIP V----- -------- | 125 |
| SEQ-ID-171-GI-34905954 | TINLAAICTP ADYNTRPLDT YSNFIDALP VVKYCSENNK RLIHFSTCEV | 150 |
| SEQ-ID-168-GI-85718018 | TVNLAAICTP ADYNTRPLDT YSNFIDALP VVKYCSENGK RLIHFSTCEV | 139 |
| SEQ-ID-169-GI-37379419 | VNNLAAICTP ADYNTRPLDT YSNFIDALP VVKYCSENGK RLIHFSTCEV | 140 |
| SEQ-ID-165-ANNOT-1541782 | TINLAAICTP ADYNTRPLDT YSNFIDALP VAKYCSENNK RLIHFSTCEV | 142 |
| SEQ-ID-160-LOCUS-AT1G08200 | TINLAAICTP ADYNTRPLDT YSNFIDALP VVKYCSENNK RLIHFSTCEV | 142 |
| SEQ-ID-162-CLONE-1459647 | TINLAAICTP ADYNTRPLDT YSNFIDALP VVKYCSENNK RLIHFSTCEV | 142 |

| SEQ ID | Sequence | Pos |
|---|---|---|
| SEQ-ID-172-GI-92894433 | YGKTI GSFLS KDSPLRHDPA YYMLKEDESP CI FGPL EKQR WSYACAKQLI | 175 |
| SEQ-ID-171-GI-34905954 | YGKTI GSFLP TDHPLRKEPE FYVLKEDESP CI FGPVKQR WSYACAKQLI | 200 |
| SEQ-ID-168-GI-85718018 | YGKTI GAFLP EDSPLRQDPA YFVLSEEASP CI FGPL EKQR WSYACAKQLI | 189 |
| SEQ-ID-169-GI-37379419 | YGKTI GAFLP EXSPLRQDPA YYVLKEDVSP CI FGSI EKQR WSYACAKQLI | 190 |
| SEQ-ID-165-ANNOT-1541782 | YGKTI GSFLP KDSPLRQDPA YYVLKEDASP CI FGSI EKQR WSYACAKQLI | 192 |
| SEQ-ID-160-LOCUS-AT1G08200 | YGKTI GSFLP KDHPLRQDPE FYVLKEDI SP CI FGSI EKQR WSYACAKQLI | 192 |
| SEQ-ID-162-CLONE-1459647 | YGKTI GSFLP KDHPLRQDPD FYVLKEDTSP CI FGSI EKQR WSYACAKQLI | 192 |

Sequence alignment showing multiple sequences (SEQ-ID:172-GI:92894433, SEQ-ID:171-GI:34905954, SEQ-ID:168-GI:85718018, SEQ-ID:169-GI:37379419, SEQ-ID:165-ANNOT:1541782, SEQ-ID:160-LOCUS:AT1G08200, SEQ-ID:162-CLONE:1459647) aligned across four blocks with position numbers 225–241, 275–292, 325–342, and 372–389.

Block 1 (positions ~225–241):
- ERLIYGEGDE KGLEFTIVRP FNWIGPRMDF PGVDGPSEG VPRVLACFSN — 225
- ERLIFAEGAE NGLEFTIVRP FNWIGPRMDF PGVDGPSEG VPRVLACFSN — 250
- ERLIYAEGAE NGLEFTIVRP FNWIGPRMDF PGIDGPSEG VPRVLACFSN — 239
- ERLVYAEGAE NGLEFTIVRP FNWIGPRMDF PGIDGPSEG VPRVLACFSN — 240
- ERLVYAEGAE NGLEFTIVRP FNWIGPRMDF PGVDGPSEG VPRVLACFSN — 242
- ERLVYAEGAE NGLEFTIVRP FNWIGPRMDF PGIDGPSEG VPRVLACFSN — 242
- ERLVYA-GAE NGLEFTIVRP FNWIGPRMDF PGIDGPSEG VPRVLACFSN — 241

Block 2 (positions ~275–292):
- NLLRGEPLKL VDGGESQRTF VYIKDAIEAV LLMIENPARA NGKIFNVGNP — 275
- NLLRREPLKL VDGGQSQRTF VYIKDAIEAV HLMIENPARA NGQIFNVGNP — 300
- NLLRHEPLKL VDGGHSQRTF VYIKDAIEAV FLMIENPARA NGHIFNVGNP — 289
- NLLRHEPLKL VDGGESQRTF VYIKDAIEAV LLMIENPARA NGQIFNVGNP — 290
- ALLRREPLKL VDGGESQRTF VYIKDAIEAV LLMIENPSRA NGHIFNVGNP — 292
- NLLRREPLKL VDGGESQRTF VYIKDAIEAV LLMIENPERA NGHIFNVGNP — 292
- NLLRREPLKL VDGGESQRTF VYIKDAIDAV LLMIENPERA NGRIFNVGNP — 291

Block 3 (positions ~325–342):
- NNEVTVRELA EMMLKVYSKV SGDQPLETPT DVSSKEFYG EGYDDSDKRI — 325
- NNEVTVRQLA EMMTEVYANV SGEPPLDEPM DVSSKQFYG EGYDDSDKRI — 350
- NNEVTVRKQLA EMMTQVYSKV SGETPLETPT DVSSKEFYG EGYDDSDKRI — 339
- NNEVTVRQLA EMMTQVYSKV SGESPPETPT VDVSSKEFYG EGYDDSDKRI — 340
- NNEVTVRQLA EMMTAVYANV SGEPALEEPT VDVSSKEFYG EGYDDSDKRI — 342
- NNEVTVRQLA EMMTEVYAKV SGETAJESPT DVSSKEFYG EGYDDSDKRI — 342
- NNEVTVRQLA EMMTKVYSKV SGETAIESPI DVSSKEFYG EGYDDSDKRI — 341

Block 4 (positions ~372–389):
- PDMTIINKQL GWNPKTSLED LESTLTYQH KTYAEAIKKV LAQTIAS— — 372
- PDMTIINKQL GWNPKTPLKD LLETTLTYQH KTYAEAIKRQ MSQASSS— — 398
- PDMTIINRQL GWNPKTSLWD LLESTLTYQH RTYAEAVKQA MSKTTAN— — 386
- PDMTIINRQL GWNPKTSLWD LLESXLTYQH RTYAEAVKQA MSKTTAN— — 387
- PDMTLINRQL GWNPKTSLWD LLDSTLTYQH KTYAEAIKKV MSQPTTS— — 389
- PDMTIINRQL GWNPKTSLWD LLESTLTYQH TTYAEAIKKA TSKPVAS— — 389
- PDMTIINRQL GWNPKTSLWD LLESTLTYQH RTYAEAVKKA TSKPVAS— — 388

```
                                                              49
                                                              48
                                                              49
                                                              49
                                                              48

MEALKMKQFF  AML V  VAM-MM  AASSV SA ADA  PAPSPTSDAT  T LFVPT L AS
MEAMKMK MMV  F  MV AV  AF   SAATAATVEA   PAPSPTSDA-  AMFVPALFAS
MEAK KMMVVF  MI VAVAFSAV   GQAA ATVEA    PAPSPTSDA-  AMFVPALFAS
MEAMKMMVVF   MVVAVAFSAI    GQATAATVEA    PAPSPTSDA-  AMFVPALFAS
-MAMKMMVVF   MVVAVAFSAV    GQAA AATVEA   PAPSPTSDA-  AMFVPT LFAS
```

SEQ·ID·181·GI·92881787
SEQ·ID·176·ANNOT·867623
SEQ·ID·178·GI·830322230
SEQ·ID·177·CLONE·873156
SEQ·ID·180·CLONE·1121732

```
FVAL VF GLLF   59
VVALASG F  F   58
VVALASGLLF     59
VVALASGLLF     59
VVALASGLLF     58
```

SEQ·ID·181·GI·92881787
SEQ·ID·176·ANNOT·867623
SEQ·ID·178·GI·830322230
SEQ·ID·177·CLONE·873156
SEQ·ID·180·CLONE·1121732

| | | | | | | |
|---|---|---|---|---|---|---|
| SEQ·ID·188·CLONE·624590 | A S G D S K C H N P | M N V L E V M E K S | T F C L Q A P G D S | F T R R S T F D S V | L A G C I P V F F S | 368 |
| SEQ·ID·187·CLONE·1924705 | D H G N P K C Y N P | S E I L K V M R E S | R F C L Q A P G D S | F T R R S T F D A I | L S G C I P V F F S | 383 |
| SEQ·ID·183·ANNOT·868753 | E N G G S R C H N P | M T V L G V M A R S | R F C L Q A P G D S | F T R R S T F D A M | L A G C I P V F F S | 363 |
| SEQ·ID·185·ANNOT·1441800 | G K G P S K C H D P | E V L K V M S Q S | Q F C L Q A P G D S | F T R R S T F D S V | L A G C I P V F F S | 389 |
| | | | | | | |
| SEQ·ID·188·CLONE·624590 | E H T A Y T Q Y K W | Y F P – R E R D T Y | S V F I D E R E V | E G – – – – K E K M M | E E V L L G F G E | 414 |
| SEQ·ID·187·CLONE·1924705 | R H T A Y T Q Y S M | F L P – E E A S K Y | S V Y M D E Q S – – | – – – – – E E S K R | E E V L M K T P K | 425 |
| SEQ·ID·183·ANNOT·868753 | P H T M Y T Q Y M W | Y L P – D D K R S M | S V F M D E – – – – | – – – – K N N T H | E Q E L L R I S E | 403 |
| SEQ·ID·185·ANNOT·1441800 | P H T V Y T Q Y E W | F F P A G D A R E Y | S V Y I D E N A L K | T G N G S K R V V S | E E E L F K I E R | 439 |
| | | | | | | |
| SEQ·ID·188·CLONE·624590 | K E V E R M R E V L | I G L I P I L T Y A | H P N A – – – T A A | F P D V D V M L R | R L – – S R R V T H H | 460 |
| SEQ·ID·187·CLONE·1924705 | E E V D T M R A T V | D M I P R L T Y A | H P N A S H S D L G | F E D A V D V A L Q | A L – – A Q H V R D K | 474 |
| SEQ·ID·183·ANNOT·868753 | N E V V Q M R E I V | D L I P R L T Y A | H P N S – – T N Y D | L P D A V D I A L E | A L – – A K Q A R D N | 450 |
| SEQ·ID·185·ANNOT·1441800 | E K V E R M R S A V | N L M P R L T Y A | H P N A – – T D L G | F Q D A V D V A L E | A L W A K R L K L N | 487 |
| | | | | | | |
| SEQ·ID·188·CLONE·624590 | F N P I | 465 | | | | |
| SEQ·ID·187·CLONE·1924705 | V – – – | 475 | | | | |
| SEQ·ID·183·ANNOT·868753 | V V S L | 455 | | | | |
| SEQ·ID·185·ANNOT·1441800 | V – – – | 488 | | | | |

Figure 7B

|  |  |  |  |  |  |
|---|---|---|---|---|---|
| SEQ·ID·202·GI·50916595 | -MARFLL GAA | ATALL - -ACV | SSLL M- - - - | VPFAEAYDPL | DPNGNI TI KW | 43 |
| SEQ·ID·199·CLONE·1883580 | MSNLFLFI AR | SFFNLSSFSV | LLLFLLSFSS | FTATEAYDPL | DPNGNI TI KW | 50 |
| SEQ·ID·201·ANNOT·1450185 | -MGFLVSPMM | SLFSK- - FTV | LLLFVLWCAS | FTSTEAYDPL | DPTGNI TI KW | 47 |
| SEQ·ID·196·ANNOT·870466 | -MGFFLCSSS | - - - - - -FGI | SI FFK- -FGI | DPSEAYDPL | DPSGNI TVKW | 47 |
| SEQ·ID·197·GI·90657629 | -MAWSLDSS- | - - - - - - - -CL | TLL - - - - - - | - - - -QEAYDAL | DPDGNI TI KW | 30 |
|  |  |  |  |  |  |  |
| SEQ·ID·202·GI·50916595 | DI TQWTPDGY | VAVVTI YNFQ | KYRHI QAPGW | SLGWAWAKKE | I WSMAGGQA | 93 |
| SEQ·ID·199·CLONE·1883580 | DI MSWTADGY | VAVVTI FNFQ | QYRHI QAPGW | TLGWKWSKKE | VI WSMMGGQT | 100 |
| SEQ·ID·201·ANNOT·1450185 | DI I SWTADGY | VAVVTI YNFQ | QYRHI QAPGW | SLGWTWAKKE | VI WSMLGGQA | 97 |
| SEQ·ID·196·ANNOT·870466 | DI I TWTGDGY | VATVTYYNFQ | QYRHI QAPGW | TLGWSWAKRE | VI WGMNGGQT | 97 |
| SEQ·ID·197·GI·90657629 | DI MTWTADGY | VAVVTI YNFQ | QYRHI QAPGW | SLGWTWAKRE | VI WGMNGGQT | 80 |
|  |  |  |  |  |  |  |
| SEQ·ID·202·GI·50916595 | TEQGDCSAFK | ANI PHCCKRD | PRVVDLVPGA | PYNMQFGNCC | KGGVLTSWQ | 143 |
| SEQ·ID·199·CLONE·1883580 | TEQGDCSRFK | GNI PHCCKKD | PTVVDLLPGT | PYNQQI ANCC | KGGVL NSWVQ | 150 |
| SEQ·ID·201·ANNOT·1450185 | TDQGDCSKFK | GNVPHCCKKS | PTVVDLLPGT | PYNQQTANCC | KGGVI SSWAQ | 147 |
| SEQ·ID·196·ANNOT·870466 | TEQGDCSKFK | GTI PHCCKKT | PSVVDLLPGS | PYNQQI ANCC | RGGVL NSWAQ | 147 |
| SEQ·ID·197·GI·90657629 | TEQGDCSRFK | GNI PHCCKQD | PTVVDLMPGT | PYNQQI ANCC | KGGVI NSFAQ | 130 |
|  |  |  |  |  |  |  |
| SEQ·ID·202·GI·50916595 | DPLNAVASFQ | I TVGHSGTSN | KTVKAPKNFT | LKAPGPGYSC | GLAQEVKPPT | 193 |
| SEQ·ID·199·CLONE·1883580 | DPATAASSFQ | VSVGQAGTTN | KTVRVPKNFT | LKAPGPGYTC | GPAKI VK- PS | 199 |
| SEQ·ID·201·ANNOT·1450185 | DPANAASSFQ | LSVGSAGTSN | KTVRLPKNFT | LKAPGPGYTC | ARAKI VK- PT | 196 |
| SEQ·ID·196·ANNOT·870466 | DPATAVSAFQ | LTVGQAGTTN | KTVRVPKNFT | LKAPGPGYTC | SPAKI VK- PT | 196 |
| SEQ·ID·197·GI·90657629 | DPATTVSAFQ | LTVGQAGTTN | KTVRVPKNFT | LKAPGPGYTC | SPGNI VK- PS | 179 |
|  |  |  |  |  |  |  |
| SEQ·ID·202·GI·50916595 | RFI SLDGRRT | TQAHVTWNVT | CTYSQFVAQR | APTCCVSLSS | FYNETI VNCP | 243 |
| SEQ·ID·199·CLONE·1883580 | RFVTADKRRV | TQAL MTWNVI | CTYSQFLAQK | TPTCCVSLSS | FYNETI VPCP | 249 |
| SEQ·ID·201·ANNOT·1450185 | RFMSTDKRRI | TQAL MTWNVI | CTYSQFLAQK | TPSCCVSLSS | FYNDTI VPCP | 246 |
| SEQ·ID·196·ANNOT·870466 | RFI GTDKRRV | TQAL MTWNVI | CTYSQFLAQK | TPTCCVSLSS | FYNKTI VSCP | 246 |
| SEQ·ID·197·GI·90657629 | RFI SADKRRI | TQAL MTWNVI | CTYSQFLAQK | TPTCCVSLSS | FYTNTI VSCP | 229 |
|  |  |  |  |  |  |  |
| SEQ·ID·202·GI·50916595 | KCACGCQ- - - | KKPGSCVEGN | SPYLASVVNG | PGKGSL T - PL | VQCTPHMCPI | 290 |
| SEQ·ID·199·CLONE·1883580 | QCACGCQ- NT | SQPGSCVDPK | APHI ASVVPS | TGKNNYA- PL | VQCTSHMCPV | 297 |
| SEQ·ID·201·ANNOT·1450185 | KCTCGCQRNN | SDSGGCVDPN | APHLASVVSS | LGNNNPM- PL | VQCTSHMCPI | 295 |
| SEQ·ID·196·ANNOT·870466 | TCSCGCR- NT | SQPGNCVDPK | GPRI ASVI PN | PGKNAYI PPL | VQCTKHMCPV | 295 |
| SEQ·ID·197·GI·90657629 | TCACGCR- KT | SETTCVDPK | GPRI ASVI QS | PGKNSYMPPL | VQCTNHMCPI | 278 |

Figure 8A

| | | | | | |
|---|---|---|---|---|---|
| SEQ-ID-202-GI-50916595 | RVHWHVKLNY | RDYWRVKVTI | TNWNYRMNYS | QWNLVVQHPN | FENVSTVFSF | 340 |
| SEQ-ID-199-CLONE-1883580 | RVHWHVKLNY | KEYWRVKVTI | TNFNYNMNYT | QWNLVVQHPN | FDNLTQIFSF | 347 |
| SEQ-ID-201-ANNOT-1450185 | RVHWHVKLNY | KQYWRVKVTI | TNFNYNMNYT | QWNLVVQHPN | FDNLTQSFSF | 345 |
| SEQ-ID-196-ANNOT-870466 | RIHWHVKVNY | KQYWRVKVTI | TNFNYNMNYS | QWNLVVQHPN | FDNLTQTFSF | 345 |
| SEQ-ID-197-GI-90657629 | RIHWHVKVNY | KEYWRVKISI | TNFNYVMNYS | QWNVVVQHPN | FDNLTQIFSF | 328 |

| | | | | | |
|---|---|---|---|---|---|
| SEQ-ID-202-GI-50916595 | NYKSLNPYGV | NDTAMMWGV | KYYNDLLMVA | GPDGNVQSEL | LFRKDRSTFT | 390 |
| SEQ-ID-199-CLONE-1883580 | NYKSLTPYTA | NDTAMLWGV | KFFNDLLSQA | GQLGNVQSEL | LFRKDKATFT | 397 |
| SEQ-ID-201-ANNOT-1450185 | NYQSLSPYSA | NDTAMLWGV | KFYNDLLMQA | GRSGNVQSEL | LFRKDKSTFT | 395 |
| SEQ-ID-196-ANNOT-870466 | NYKPLTPYAS | NDTGLLWGI | KFYNDLLMQA | GPFGNVQSEL | LFQKEASAFT | 395 |
| SEQ-ID-197-GI-90657629 | NYKPLTPYAS | NDTGLLWGV | KYYNDLLMQA | GPSGNVQSEL | LFRKDPLSFT | 378 |

| | | | | | |
|---|---|---|---|---|---|
| SEQ-ID-202-GI-50916595 | FDKGWAFPRR | YFNGESCVM | PSPDLYPWLP | PSSTPRF-RT | VFLLMSFLVC | 439 |
| SEQ-ID-199-CLONE-1883580 | FEKGWAFARR | YFNGDNCVM | PPPDAYPWLP | NGSSHQLST | LSLLTTL | 445 |
| SEQ-ID-201-ANNOT-1450185 | FDKGWAFPRR | YFNGDNCVM | PPPDAYPWLP | NASSRQLTSP | LMLMIAFF | 443 |
| SEQ-ID-196-ANNOT-870466 | FEKGWAFPRR | YFNGDNCVM | PPPDSYPWLP | NTGSHKSVGS | LFAAMALL | 443 |
| SEQ-ID-197-GI-90657629 | LEKGWAFPRR | YFNGDNCVM | PPPDSYPWRLP | NFGSSLLGSR | PVAVLTFL | 426 |

| | | |
|---|---|---|
| SEQ-ID-202-GI-50916595 | GTLAFLHNHL | VLDKNCGKC | 458 |
| SEQ-ID-199-CLONE-1883580 | AAMAFLLGYA | ---------- | 455 |
| SEQ-ID-201-ANNOT-1450185 | SVLAFLYGYA | ---------- | 453 |
| SEQ-ID-196-ANNOT-870466 | LIVFLHGNL | ---------- | 452 |
| SEQ-ID-197-GI-90657629 | SVTAFLHRNL | ---------- | 436 |

| | | | | | | |
|---|---|---|---|---|---|---|
| SEQ-ID-204-ANNOT-887718 | YAYQSLNAVE | ARRYRWVRVN | HMVYDYCTDR | SRFPVPPPEC | RA-- | 292 |
| SEQ-ID-214-GI-53653786 | VEYQALSAIE | ARRYRWVRMN | HVIYDYCQDK | SRYPMTPHEC | LSGI | 293 |
| SEQ-ID-211-CLONE-546224 | AAYQALNAIE | ARRYRWVRLN | HIIYDYCQDK | SRFPVIPPEC | LAGI | 294 |
| SEQ-ID-213-GI-886049930 | TAYQALNALE | YRRYKWVRMN | HMIYDYCSDR | SRFPKPPPEC | VAGI | 287 |
| SEQ-ID-208-ANNOT-1457442 | ATYQALNAME | ARKYRWVRMN | HMIYDYCADK | SRYPITTPPEC | VAGI | 292 |
| SEQ-ID-206-CLONE-1835843 | TAYQALNAME | ARRYRWVRMN | HMIYDYCTDK | SRYPVTPPEC | MAGI | 288 |

Figure 9B

```
SEQ-ID-218-CLONE-1014844  MMMGKEDLGL SLSLGFSQNH NPHQMNLNPN SSLSNNLQRL PWNQTFDPTS  50
SEQ-ID-220-GI-89257493    MMMRKEDLGL SLSLGLSQDH TPLQ-SQNPN SSISNNLHRF PWNQTFASTS  49

SEQ-ID-218-CLONE-1014844  DLRKIDVNSF PSTVNCEEDT GVSSPNSTIS STISL-GKRSE REGISGTGVG  99
SEQ-ID-220-GI-89257493    DLGKIDVNSL PRTVDCEEEP GVSSPNSTIS STISGGKRSE REGIS-----  94

SEQ-ID-218-CLONE-1014844  SGDDHDEITP DRGYSRGTSD EEEDGGETSR KKLRLSKDQS AFLEETFKEH  149
SEQ-ID-220-GI-89257493    ---EHDEITP DRGYSRGNSD EEEDGGETSR KKLRLSKDQS AFLEGTFKEH  141

SEQ-ID-218-CLONE-1014844  NTLNPKQKLA LAKKLNLTAR QVEVWFQNRR ARTKLKQTEV DCEYLKRCVE  199
SEQ-ID-220-GI-89257493    NTLNPKQKLA LAKKLNLTAR QVEVWFQNRR ARTKLKQTEV DCEYLKRCVE  191

SEQ-ID-218-CLONE-1014844  KLTEENRRLQ KEAMELRTLK LSPQFYGQMT PPTTLIMCPS CERVAGPSSS  249
SEQ-ID-220-GI-89257493    KLTEENRRLQ KEAMELRTLK LSPQFYGQMT PPTTLIMCPS CERVAGPSS-  240

SEQ-ID-218-CLONE-1014844  NHHHNHRPVS NPWIACAGQ VAHGLNFEAL RPRS  283
SEQ-ID-220-GI-89257493    NHQHNHRPVP VNPWVACAGQ VTHGLNFEAL RPRS  274
```

| | | | | | | |
|---|---|---|---|---|---|---|
| SEQ-ID-276-GI-3288180 | RI PYQAMDFG | WGSPTFFGLS | NIFYDGQCFL | PSQN-GDGS | MTLAINLFSS | 434 |
| SEQ-ID-273-GI-6469032 | RLPVHESDFG | WGRPIHMGPA | CILYEGTVYI | LPSPN-KDGS | SLAVCLDAE | 419 |
| SEQ-ID-274-GI-40644084 | RLPVHECDFG | WGRPIHMGPA | CILYEGTIYI | LPSPNSKDRN | RLAVCLDAG | 418 |
| SEQ-ID-275-GI-76573303 | RLPVHECDFG | WGRPIHMGPA | CILYEGTILYI | LPSPNTKDRN | RLAVCLDAG | 423 |
| SEQ-ID-262-GI-50926145 | RLPIHDADFG | WGRPVFMGPG | GIAYEGLAFV | LPSAN-KDGS | LSIAISLQAE | 430 |
| SEQ-ID-263-CLONE-465877 | RLPIHDADFG | WGRPVFMGPG | GIAYEGLAFV | LPSAN-RDGS | LSIAISLQAE | 428 |
| SEQ-ID-270-CLONE-1795778 | RLPIHDADFG | WGRPVFMGPG | GIAYEGLAFV | LPSSN-RDGS | LSVAISLQAE | 434 |
| SEQ-ID-267-GI-324400295 | RLPIHDADFG | WGRPVFMGPG | GIAYEGLAFV | LPSAN-RDGS | LSVAISLQAE | 428 |
| SEQ-ID-268-CLONE-741711 | RLPIHDADFG | WGRPIFMGPG | GIAYEGLAFV | LPSAS-RDGS | LSVAISLQAE | 430 |
| SEQ-ID-259-CLONE-660782 | RLPIHDADFG | WGRPIFMGPG | GIAYEGLSFI | LPSST-NDGS | LSVAIALQSE | 417 |
| SEQ-ID-258-GI-274475616 | RLPIHDADFG | WGRPIFMGPG | GIAYEGLAFV | LPSPT-NDGS | LSVAISLQSE | 423 |
| SEQ-ID-257-GI-825568711 | RLPIHDADFG | WGRPIFMGPG | GIAFEGLSFV | LPSAT-NDGS | QSVAISLQAE | 426 |
| SEQ-ID-240-CLONE-114130 | RLPIYDADFG | WGRPIFMGPG | GIPYEGLSFV | LPSPT-NDGS | LSVAISLQSE | 421 |
| SEQ-ID-242-CLONE-1920088 | RLPIHDADFG | WGRPIFMGPG | GIPYEGLSFV | LPSPN-NDGS | LSVAISLQTE | 419 |
| SEQ-ID-250-ANNOT-1448109 | RLPIHDADFG | WGRPIFMGPG | GIAYEGLSFI | LPSST-NDGS | LSVAISLQAE | 410 |

| | | | |
|---|---|---|---|
| SEQ-ID-276-GI-3288180 | HLSLFKKYEM | DF-- | 446 |
| SEQ-ID-273-GI-6469032 | HMPLFKEFLY | DF-- | 431 |
| SEQ-ID-274-GI-40644084 | HMSLFEKYLY | EL-- | 430 |
| SEQ-ID-275-GI-76573303 | HMPLFEKYLC | F-- | 433 |
| SEQ-ID-262-GI-50926145 | HMEKFRKL | EV-- | 442 |
| SEQ-ID-263-CLONE-465877 | HMEKFRKL | GANC | 442 |
| SEQ-ID-270-CLONE-1795778 | HMEKFRKFI | DF-- | 446 |
| SEQ-ID-267-GI-324400295 | HMEKFRKMF | F-- | 440 |
| SEQ-ID-268-CLONE-741711 | HMEKFRKMI | F-- | 442 |
| SEQ-ID-259-CLONE-660782 | HMEKFKDFLY | DI-- | 429 |
| SEQ-ID-258-GI-274475616 | HMKLFEKFLY | DI-- | 435 |
| SEQ-ID-257-GI-825568711 | HMKSFSKLY | DI-- | 438 |
| SEQ-ID-240-CLONE-114130 | HMKLFEKFLF | EI-- | 433 |
| SEQ-ID-242-CLONE-1920088 | HMKVFEKFY | DI-- | 431 |
| SEQ-ID-250-ANNOT-1448109 | HMKLFEKFIY | DIKE | 424 |

Figure 12E

```
SEQ-ID-286-CLONE-38915    MLQGFLFLLS VVLLFSSSAA ACDRCLHSSK AAYFSSASAL SSGACAYGSM   50
SEQ-ID-287-CLONE-1375697  --MGSCFLVL VVLLFSSSVN ACDRCLHRSK AAYFSSASAL SSGACSYGSM   48

SEQ-ID-286-CLONE-38915    ATGFFAGHIA AALPSIYKDG SGCGACFQVR CKNPTLCSSK GTTVIVTDLN  100
SEQ-ID-287-CLONE-1375697  ATGFFAGHIA AAVPSIYKDG AGCGACFQVR CTNPSLCSTK GTTVMVTDLN   98

SEQ-ID-286-CLONE-38915    KTNQTDLVLS SRAFRAMAKP VVGADRDLLK QGIVDIEYRR VPCDYGNKK-  149
SEQ-ID-287-CLONE-1375697  RSNQTDLLLS SRAFRAMAKP VLGADRDLLR QGIVDVQYQR VPCDYGNKKM  148

SEQ-ID-286-CLONE-38915    MNVRVEESSK NPNYLAIKLL YQGGQTEV  177
SEQ-ID-287-CLONE-1375697  MNVRVEESSK KPNYLAIKLL --------  168
```

| SEQ ID NO | Sequence | % |
|---|---|---|
| SEQ·ID·NO·332·CLONE·1756603 | QYI LDT SVYP REPE SMKELR EI TAKHPWNL MTTSADEGQF LNMLI KLI GA | 91 |
| SEQ·ID·NO·337·CLONE·700120 | QYI LET SVYP REHE CMKELR EI TAN HPWNL MTTSADEGQF LNMLL KLI GA | 100 |
| SEQ·ID·NO·339·GI·49618875 | QYI LET SVYP REHE CMKELR EVTAN HPWNL MTTSADEGQF LNLLL KLI GA | 93 |
| SEQ·ID·NO·340·GI·4104459 | QYI LET SVYP REPE PMKELR RVTAKHPWNL MTTSADEGQF LGLLL KLI NA | 92 |
| SEQ·ID·NO·338·GI·96772920 | QYI LET SVYP REPE PL KELR EVTAKHPWNL MTTSADEGQF LGLLL KLI NA | 92 |
| SEQ·ID·NO·333·GI·2995934 | QYI LET SVYP REPQ PMKELR DI TAKHPWNL MTTSADEGQF LNMLL KLI NA | 87 |
| SEQ·ID·NO·330·GI·305803342 | QYI LET SVYP REPQ PMKELR RT AKHPWNL MTTSADEGQF LNLLL KLI NA | 78 |
| SEQ·ID·NO·329·CLONE·1605906 | QYI LET SVYP REPE PMKELR EVTAKHPWNL MTTSADEGQF LNMLL KLI NA | 80 |
| SEQ·ID·NO·296·CLONE·538586 | QYI LET SVFP REPE PMKELR EVTAKHPWNI MTTSADEGQF LNMLL KLI NA | 80 |
| SEQ·ID·NO·305·GI·684942 | QYI LET SVYP REHE AMKELR EVTAKHPWNI MTTSADEGQF SMLLL KLI NA | 80 |
| SEQ·ID·NO·307·GI·92873946 | QYI LET SVYP REHE PMKELR ELTAKHPWNI MTTSADEGQF SMLLL KLI NA | 80 |
| SEQ·ID·NO·316·GI·40795556 | QYI LET SVYP REPE PMKELR EVTAKHPWNL MTTSADEGQF LNMLL KLI NA | 80 |
| SEQ·ID·NO·323·GI·57339373 | QYI LET SVYP REPE SMKELR EVTAKHPWNI MTTSADEWQF LNMLL KLI NA | 80 |
| SEQ·ID·NO·308·GI·992610 | QYI LET SVYP REPE SMKELR EAT AKHPWNI MTTSADEGQF LNMSL KLI NA | 74 |
| SEQ·ID·NO·312·GI·480093469 | QYI LET SVYP REPE PMKELR EVTAKHPWNI MTTSADEGQF LNMLL KLI NA | 74 |
| SEQ·ID·NO·315·GI·829941443 | QYI LET SVYP REPE SMKELR EVTAKHPWNL MTTSADEGQF LNMLI KLV NA | 80 |
| SEQ·ID·NO·297·GI·682718598 | QYI LET SVYP REPE SMKELR EI TAKHPWNI MRT SADEGQF LNMLI KLI NA | 79 |
| SEQ·ID·NO·327·GI·6561881 | QYI LET SVYP REPE PMKELR EVTAKHPWNL MTTSADEGQF LNMLI KLI NA | 65 |
| SEQ·ID·NO·293·GI·1679853 | QYI LET SVYP KEPE PMKELR EVTAKHPWNL MTTSADEGQF LNMLI KLI NA | 73 |
| SEQ·ID·NO·291·CLONE·8049 | QYI LET SVYP REPE AMKELR EI TAKHPWNI MTTSADEGQF LNMLI KLV NA | 92 |
| SEQ·ID·NO·292·CLONE·1365873 | QYI LET SVYP REPE AMKELR EI TAQHPWNL MTTSADEGQF LNMLI KLV NA | 91 |
| SEQ·ID·NO·294·GI·576639629 | QYI LET SVYP REPE PMKELR ELTAKHPWNI MTTSADEGQF LNMLI KLI NA | 80 |
| SEQ·ID·NO·314·GI·247455969 | QYI LET SVYP REPE CMKELR EI TAKHPWNI MTTSADEGQF SMLLL KLI NA | 75 |
| SEQ·ID·NO·324·GI·557248355 | QYI LET SVYP REPE AMKELR EI TAKHPWNI MTTSADEGQF LNMLL KLI NA | 80 |
| SEQ·ID·NO·306·GI·1000519 | QYI LET SVYP REPE CMKELR EVTAKHPWNI MTTSADEGQF LNMLI KLV NA | 75 |
| SEQ·ID·NO·309·GI·47680455 | QYI LET SVYP REPE AMKELR EVTAKHPWNI MTTSADEGQF LNMLL KLI NA | 80 |
| SEQ·ID·NO·313·GI·46394464 | QYI LET SVYP REPE CMKELR EVTAKHPWNI MTTSADEGQF LNMLL KLI NA | 80 |
| SEQ·ID·NO·326·GI·1934859 | QYI LET SVYP REPE PMKELR EVTAKHPWNI MTTSADEGQF LNMLL KLV NA | 80 |
| SEQ·ID·NO·311·GI·13249171 | QYI LET SVYP REPE CMKELR EVTAKHPWNI MTTSADEGQF LNMLL KLV NA | 72 |
| SEQ·ID·NO·300·GI·7271916 | QYI LET SVYP REPE CMKELR EVTAKHPWNI MTTSADEGQF LNMLL KLV NA | 80 |
| SEQ·ID·NO·302·GI·3023436 | QYI LET SVYP REPE CMKELR EVTAKHPWNI MTTSADEGQF LNMLL KLV NA | 80 |
| SEQ·ID·NO·304·ANNOT·1514289 | QYI LET SVYP REPE CMKELR EVTAKHPWNI MTTSADEGQF LNMLL KLV NA | 80 |

Figure 14B

| SEQ ID | Sequence | Length |
|---|---|---|
| SEQ-ID-NO-332-CLONE-1756603 | KK T MEI GVYT GYSLLATALA PEDGT LAM DI NRENYELG LPC I EKAGVA | 141 |
| SEQ-ID-NO-337-CLONE-700120 | KK T MEI GVYT GYSLLATALA PDDGT LAM DI NRENYELG LPC I EKAGVA | 150 |
| SEQ-ID-NO-339-GI-49618875 | KK T MEI GVYT GYSLLATALA PDDGI LAM DI NRENYELG LPS I EKAGVA | 143 |
| SEQ-ID-NO-340-GI-4104459 | KNT MEI GVYT GYSLLATALA PDDGKI LAM DI NRENYDI G LPT I EKAGVA | 142 |
| SEQ-ID-NO-338-GI-96772920 | KNT I EI GVYT GYSLLSTALA PDDGKI LAM DI NRENYDLG LPM EKAGVA | 142 |
| SEQ-ID-NO-333-GI-2995934 | KNT MEI GVYT GYSLLSTALA PDDGKI LAL DI NRENYEI G LPV I QKAGVA | 137 |
| SEQ-ID-NO-330-GI-30580342 | KNT MEI GVYT GYSLLSTASALA PDDGKI LAM DI NRENYEI G LPV I I QKAGVA | 128 |
| SEQ-ID-NO-329-CLONE-1605906 | KNT MEI GVYT GYSLLATALA PEDGKI LAM DI NKENYEI G LPV I KKAGVA D | 130 |
| SEQ-ID-NO-296-CLONE-538586 | KNT MEI GVYT GYSLLATALA PDDGKI LAM DI NKENYEI G LPV I KKAGVA D | 130 |
| SEQ-ID-NO-305-GI-684942 | KNT MEI GVYT GYSLLATALA PEDGKI LAM DI NRENYELG LPV I QKAGVA | 130 |
| SEQ-ID-NO-307-GI-92873946 | KNT MEI GVYT GYSLLATALA PDDA KI LAM DI NRENYEI G LPV I EKAGVA G | 130 |
| SEQ-ID-NO-316-GI-40795556 | KNT MEI GVYT GYSLLATALA PDDGKI LAM DI NRENFEI G LPV I EKAGVA G | 130 |
| SEQ-ID-NO-323-GI-57739373 | KNT MEI GVYT D YSLLATALA PDDGKI LAM DI NRENYDI G LPV I EKAGLA | 130 |
| SEQ-ID-NO-308-GI-992610 | KNT MEI GVYT GYSLLATALA PDDGKI LAM DI NRENYEI G LPI I EKAGVA | 124 |
| SEQ-ID-NO-312-GI-48093469 | KNT MEI GVYT GYSLLATALA PDDGKI LAM DI NRENYEI G L RP I EKAGVA | 124 |
| SEQ-ID-NO-315-GI-82941443 | KNT MEI GVYT GYSLLATALA PDDGKI LAM DI NRENYEI G L PK I EKAGVA | 130 |
| SEQ-ID-NO-297-GI-68271859 | KNT MEI GVFT GYSLLATALA PDDGKI LAM DV NRENYEI G LPI I EKAGVA | 129 |
| SEQ-ID-NO-327-GI-6561881 | KNT MEI GVYT GYSLLATALA PDDGKI LAM DV NRENYEI G LPI I EKAGLA | 115 |
| SEQ-ID-NO-293-GI-1679853 | KNT MEI GVYT GYSLLATALA PDDGKI LAM DI NRENYEI G LPI I EKAGLA | 123 |
| SEQ-ID-NO-291-CLONE-8049 | KNT MEI GVYT GYSLLATALA PDDGKI LAM DI NRENYELG LPI I EKAGLA | 142 |
| SEQ-ID-NO-292-CLONE-1365873 | KNT MEI GVYT GYSLLATAMA PDDGKI LAM DI NRENYELG LPI I EKAGLA | 141 |
| SEQ-ID-NO-294-GI-57639629 | KNT MEI GVYT GYSLLATALA PDDGKI LAM DI NRENYELG LPI I EKAGLA | 130 |
| SEQ-ID-NO-314-GI-24745969 | KNT MEI GVYT GYSLLATALA G PDDGKI LAM DI NRENYELG LPV I QKAGLA | 125 |
| SEQ-ID-NO-324-GI-55724835 | KNT MEI GVYT GYSLLATALA PDDGKI LAM DI NKENYELG LPV I EKAGLA | 125 |
| SEQ-ID-NO-306-GI-1000519 | KNT MEI GVYT GYSLLATALA PDDGKI LAM DI NRENYELG LPV I EKAGLA | 130 |
| SEQ-ID-NO-309-GI-47680455 | KNT MEI GVYT GYSLLATALA PDDGEI LAM DI NRENYELG LPV I EKAGLA | 125 |
| SEQ-ID-NO-313-GI-46394464 | KNT MEI GVYT GYSLLATALA PDDGKI LAM DI NRENYELG LPV I EKAGLA | 130 |
| SEQ-ID-NO-326-GI-1934859 | KNT MEI GVYT GYSLLATALA PDDGKI LAM DI NRENYELG LPV I EKAGLA | 130 |
| SEQ-ID-NO-311-GI-13249171 | KNT MEI GVYT GYSLLATALA PDDGKI LAM DI NRENYELG LPV I EKAGVA X | 122 |
| SEQ-ID-NO-300-GI-7271916 | KNT MEI GVYT GYSLLATALA PDDGKI LAM DI NRENYELG LPV I QKAGVA | 130 |
| SEQ-ID-NO-302-GI-3023436 | KNT MEI GVYT GYSLLATALA PDDGKI LAM DI NRENYELG LPV I QKAGVA | 130 |
| SEQ-ID-NO-304-ANNOT-1514289 | KNT MEI GVYT GYSLLATALA PEDGKI LAM DI NRENYELG LPV I QKAGVA | 130 |

| SEQ ID | Seq1 | Seq2 | Seq3 | Seq4 | Num |
|---|---|---|---|---|---|
| SEQ·ID·NO·332·CLONE·1756603 | RVEI | CQL PVG | DGVTL CRRVK | --- | 258 |
| SEQ·ID·NO·337·CLONE·700120 | RVEI | CQL PVG | DGITL CRRAK | --- | 267 |
| SEQ·ID·NO·339·GI·49618875 | RVEI | CQL PVG | DGITL CRRVK | --- | 260 |
| SEQ·ID·NO·340·GI·4104459 | RIEI | SQI PVL | DGVTL CRRVY | --- | 259 |
| SEQ·ID·NO·338·GI·96772920 | RIEI | SQI PVG | DGVTL CRRNY | --- | 259 |
| SEQ·ID·NO·333·GI·2995934 | RVEI | CQL PVG | DGITL CRRIS | --- | 254 |
| SEQ·ID·NO·330·GI·30580342 | RVEI | CQL PVG | DGITL CRRIS | --- | 245 |
| SEQ·ID·NO·329·CLONE·1605906 | RVEI | CQL PVE | DGITL CRRVS | --- | 247 |
| SEQ·ID·NO·296·CLONE·538586 | RIEI | CML PVG | DGITI CRRIK | --- | 247 |
| SEQ·ID·NO·305·GI·684942 | RIEI | CML PVG | DGITI CRRIK | --- | 247 |
| SEQ·ID·NO·307·GI·92873946 | RIEI | CML PVG | DGITV CRRIQ | --- | 247 |
| SEQ·ID·NO·316·GI·40795556 | RIEI | CML PVG | DGITL CRRVS | --- | 250 |
| SEQ·ID·NO·323·GI·5739373 | RIEI | CML PVG | DGITL CRRIS | --- | 247 |
| SEQ·ID·NO·308·GI·992610 | RVEI | CML PVG | DGVTL CRRVS | --- | 241 |
| SEQ·ID·NO·312·GI·48093469 | RVEI | CML PVG | DGVTL CRRIS | --- | 241 |
| SEQ·ID·NO·315·GI·82941443 | RIEI | CML PVG | DGITL SRRIT | --- | 247 |
| SEQ·ID·NO·297·GI·68271859 | RIEI | CML PVG | DGITL CRRIT | --- | 246 |
| SEQ·ID·NO·327·GI·6561881 | RIEI | CML PVG | DGITL CRRIS | --- | 232 |
| SEQ·ID·NO·293·GI·1679853 | RIEI | CML PVG | DGITI CRRIS | --- | 240 |
| SEQ·ID·NO·291·CLONE·8049 | RIEI | CML PVG | DGITI CRRIK | --- | 259 |
| SEQ·ID·NO·292·CLONE·1365873 | RIEI | CQL PVG | DGITL CRRVS | --- | 258 |
| SEQ·ID·NO·294·GI·57639629 | RIEI | CML PVG | DGITL P TLCRRLS | --- | 247 |
| SEQ·ID·NO·314·GI·24745969 | RIEI | CML PVG | DGITV CRRVS | --- | 242 |
| SEQ·ID·NO·324·GI·55724835 | RIEI | CML PVG | DGITV CRRVS | LSI | 247 |
| SEQ·ID·NO·306·GI·1000519 | RIEI | CML PVG | DGITL CRRIQ | --- | 242 |
| SEQ·ID·NO·309·GI·47680455 | RIEI | CML PVG | DGITL CRRIQ | --- | 247 |
| SEQ·ID·NO·313·GI·46394464 | RIEI | CML PVG | DGITL CRRIQ | --- | 247 |
| SEQ·ID·NO·326·GI·1934859 | RIEI | CML PVG | DGITL CRRIQ | --- | 249 |
| SEQ·ID·NO·311·GI·13249171 | RIEI | CML PVG | DGITL CRRIQ | --- | 247 |
| SEQ·ID·NO·300·GI·7271916 | RIEI | CML PVG | DGITL CRRIQ | --- | 239 |
| SEQ·ID·NO·302·GI·3023436 | RIEI | CML PVG | DGITL CRRIQ | --- | 247 |
| SEQ·ID·NO·304·ANNOT·1514289 | RIEI | CML PVG | DGITL CRRIQ | --- | 247 |

| SEQ ID | col1 | col2 | col3 | col4 | col5 | num |
|---|---|---|---|---|---|---|
| SEQ-ID-NO-560-GI-76789657 | | | | | | 223 |
| SEQ-ID-NO-563-GI-41581480 | | | | | | 228 |
| SEQ-ID-NO-568-GI-233307803 | | | | -VDYF | -LSFL | 256 |
| SEQ-ID-NO-503-GI-83638483 | | | | | -DDFP | 294 |
| SEQ-ID-NO-530-GI-66736124 | AENATAPP | | | | -DVL LWPNLD FYY | 272 |
| SEQ-ID-NO-548-GI-101919348 | D | | | | GQVEEMMELS PVF | 261 |
| SEQ-ID-NO-518-GI-126653935 | M | | | | -TLLKLLDTT- | 274 |
| SEQ-ID-NO-521-GI-126567773 | FSLNLQPMQQ | GVQN | -DDFS | AEI D | -DLLELLS | 255 |
| SEQ-ID-NO-569-GI-126567771 | GL | | -SDFS | VDI D | -DLWNLLD | 255 |
| SEQ-ID-NO-515-GI-1841475 | GL | | -SDFS | VDI D | -DLWDLLS | 217 |
| SEQ-ID-NO-519-GI-6552361 | | | | | -DLWDLLS | 277 |
| SEQ-ID-NO-565-GI-22266673 | FW | | -YNVF | I KTD | -DLWSMQLLN GD | 253 |
| SEQ-ID-NO-534-GI-387707418 | FW | | -YDVF | I RAG | -DLPEL PEF- | 272 |
| SEQ-ID-NO-538-GI-387707432 | PCFSAGDDWM | DDVRALATFL | | DTD | -CLQEL | 270 |
| SEQ-ID-NO-571-GI-29824962 | PCFSAGDDWM | DDVRALASFL | | DTD | -DAWNLCA | 248 |
| SEQ-ID-NO-546-GI-51872289 | | | -FDDL | GMLM | -DAWNLCA | 198 |
| SEQ-ID-NO-507-ANNOT-1471346 | | | | | -DLMDYVI CP P | 270 |
| SEQ-ID-NO-494-GI-89058600 | LY | | -EEYL | QLLEI DDRQD | QVLDSFADS LLV | 233 |
| SEQ-ID-NO-492-GI-147744710 | | | | | -GFSSHYRLV L | 257 |
| SEQ-ID-NO-508-GI-119720796 | SSSYSSSDI S | SSVI GCYDF | | GLKLNT | -SVL DFSTSE MN | 266 |
| SEQ-ID-NO-544-CLONE-1418548 | SSSHSSSDI S | SSVI G-YDF | | GLKLNT | -SVL DFSTSE MN | 286 |
| SEQ-ID-NO-572-GI-42541177 | | | | | -VLRYYRPLI EEGHQTN | 268 |
| SEQ-ID-NO-536-GI-2605617 | | | | | | 239 |
| SEQ-ID-NO-533-GI-127579 | I SYSSI DI SS | | -FM | GLRT | -AML DFRSI E MK | 267 |
| SEQ-ID-NO-539-GI-125487106 | MVSMNI MA | | | | SIWFY | 252 |
| SEQ-ID-NO-542-CLONE-764797 | | | | | -GFRYFRPLE EGQYI | 247 |
| SEQ-ID-NO-567-GI-19055 | | | | | -GFRYFRPLE EGQYI | 251 |
| SEQ-ID-NO-564-GI-148524147 | GSCKGSDM | -SNG | -FDFL | GLAKKETNT | -CLFGFRSI F MK | 294 |
| SEQ-ID-NO-574-GI-148524145 | GSCKGSDM | -SNG | -FDFL | GLAKKETNT | -CLFGFRSLE MK | 294 |
| SEQ-ID-NO-134-ANNOT-858797 | I SYSSI DI SS | SNVG | -YDFL | GLKT | -RI LDFRSLE MK | 269 |
| SEQ-ID-NO-517-GI-1167484 | MVSMNI MA | -G | -YDFL | GLKTN | -GLLDYRTLE TK | 273 |
| SEQ-ID-NO-516-GI-397725415 | | | -YDFL | GLKA | -SVLDYRS- | 255 |
| SEQ-ID-NO-505-ANNOT-1460633 | TSTKTG | | | GMKS | -GVLDYRSLE MK | 271 |
| SEQ-ID-NO-549-GI-125562458 | | | | | | 222 |
| SEQ-ID-NO-552-GI-19072766 | | | -NNFL | G | -GLLEFR | 229 |
| SEQ-ID-NO-570-GI-286289961 | SVG | | -YDFL | GLKS | -GVLDYRSLE MK | 216 |
| SEQ-ID-NO-495-GI-124430478 | TTPSSAAAAA | AAA | -YDFL | GMKTN | -GVWDCTRLE MK | 265 |
| SEQ-ID-NO-509-GI-110931646 | STAPA | | -YDFL | GLKG | -GVWDYKGLE MK | 253 |
| SEQ-ID-NO-514-GI-92878899 | | | | | | 285 |
| SEQ-ID-NO-532-GI-75107028 | | | | | | 232 |
| SEQ-ID-NO-531-GI-145306631 | SG | | -YDFL | GLKA | -GVLDYRSLE MK | 244 |
| SEQ-ID-NO-498-CLONE-1836832 | SSSHSNSN | NSSG | -YDFL | GLKA | -GI LEYRSLE MK | 264 |
| SEQ-ID-NO-547-GI-119220854 | | | | GLTS | -GVLDYRGLE MK | 251 |

| | | | | | | |
|---|---|---|---|---|---|---|
| API | MLDRIL | RLLATYSVLD | CKL | -N-NLA | DG-GV-ERLY | GLAPVCKFLT | 103 |
| APA | MVDRML | HLLASYKVVS | CEV | -E--- | EG-TH-ARRY | GPTPVCKWFT | 110 |
| APD | MVDRML | RLLASYNVVS | CRT | -E-DGK | DG-RL-SRRY | GAAPVCKYLT | 109 |
| APD | MVDRML | RLLASYNVVS | CLV | -E-EGT | DG-RL-SRRY | GAAPVCKFLT | 114 |
| APD | MVDRML | RLLASYNVVS | CLV | -E-EGK | DG-RL-SRSY | GAAPVCKFLT | 113 |
| AAD | MVDRML | RLLASYNVVR | CEM | -E-EGA | DG-KL-SRRY | AAAPVCKFLT | 113 |
| AAD | MVDRML | RLLASYNVVR | CEM | -E-EGA | DG-KL-SRRY | AAAPVCKWLT | 113 |
| AAT | MVDRIL | RLLASYDVVR | CQM | -E-EGK | DG-KY-SRRY | AAAPVCKWLT | 114 |
| AAD | MVDRML | RLLASYDVVK | CQM | -E-D-K | DG-KY-ERRY | SAAPVGKWLT | 115 |
| AAD | MVDRIL | RLLASYDVVK | CQM | -E-D-K | DG-KY-ERRY | SAAPVGKWLT | 113 |

SEQ·ID·NO·647·GI·22652500
SEQ·ID·NO·621·CLONE·1064285
SEQ·ID·NO·616·GI·77818928
SEQ·ID·NO·610·GI·4104224
SEQ·ID·NO·622·GI·14578615
SEQ·ID·NO·643·GI·125560205
SEQ·ID·NO·644·GI·125602246
SEQ·ID·NO·640·CLONE·1869486
SEQ·ID·NO·613·GI·29839259
SEQ·ID·NO·614·GI·18033964

| | | | | | | | |
|---|---|---|---|---|---|---|---|
| SEQ-ID-NO-647-GI-22652500 | KNA-DG--VS | MAPLLL-MNQD | KVLMES-WYH | LKDAVLDGGI | -PFNKAY-GM | 147 |
| SEQ-ID-NO-621-CLONE-1064285 | PNQ-DG---S | MAPLLL-LTND | KVPMES--YH | LKDAVLDGGL | -PFHKAH-GM | 154 |
| SEQ-ID-NO-616-GI-77818928 | PNE-DG--VS | MSALAL-MNQD | KVLMES-WYY | LKDAVLDGGI | -PFNKAY-GM | 153 |
| SEQ-ID-NO-610-GI-4104224 | PNE-DG--VS | MAALAL-MNQD | KVLMES-WYY | LKDAVLDGGI | -PFNKAY-GM | 158 |
| SEQ-ID-NO-622-GI-14578615 | PNE-DG--VS | MAALAL-MNQD | KVLMES-WYY | LKDAVLDGGI | -PFNKAY-GM | 157 |
| SEQ-ID-NO-643-GI-125560205 | PNE-DG--VS | MAALAL-MNQD | KVLMES-WYY | LKDAVLDGGI | -PFNKAY-GM | 157 |
| SEQ-ID-NO-644-GI-125602246 | PNE-DG--VS | MAALAL-MNQD | KVLMES-WYY | LKDAVLDGGI | -PFNKAY-GM | 157 |
| SEQ-ID-NO-640-CLONE-1869486 | PNE-DG--VS | MAALAL-MNQD | KVLMES-WYY | LKDAVLEGGI | -PFNKAY-GM | 158 |
| SEQ-ID-NO-613-GI-29839259 | PNE-DG--VS | MAALTL-MNQD | KVLMES-WYY | LKDAVLDGGI | -PFNKAY-GM | 159 |
| SEQ-ID-NO-614-GI-18033964 | PNE-DG--VS | MAALAL-MNQD | KVLMES-WYY | LKDAVLDGGI | -PFNKAY-GM | 157 |

| SEQ ID | Sequence | Pos |
|---|---|---|
| SEQ ID NO:647 GI:22652500 | TAFEYHGTDP RFNKVFNQGM SNHSTI TMKK I LEVYRGF E GLK TVVDVGG | 196 |
| SEQ ID NO:621 CLONE:1064285 | TMYEYTKT DA RLNHVFNEAM KSYTTI VTGK LVELYT GF H DVATLVDVGG | 203 |
| SEQ ID NO:616 GI:77818928 | SAFEYHGTDP RFNRVFNEGM KNNSI TKK LLESYKGF E GLGTLVDVGG | 202 |
| SEQ ID NO:610 GI:4104224 | SAFEYHGTDP RFNRVFNEGM KNNSI TKK LLQLYDGF Q GLGTLVDVGG | 207 |
| SEQ ID NO:622 GI:14578615 | SAFEYHGTDP RFNRVFNEGM KNHSI TKK LLELYHGF Q GLGTLVDVGG | 206 |
| SEQ ID NO:643 GI:125560205 | TAFEYHGT DA RFNRVFNEGM KNHSV TKK LLDLYT GF D AASTVVDVGG | 206 |
| SEQ ID NO:644 GI:125602246 | TAFEYHGT DA RFNRVFNEGM KNHSV TKK LLDLYT GF D AASTVVDVGG | 206 |
| SEQ ID NO:640 CLONE:1869486 | TAFEYHGTDP RFNRVFNEGM KNHSV TKK LLEFYT GF E GV GTLVDVGG | 207 |
| SEQ ID NO:613 GI:29839259 | TAFEYHGTDP RFNRVFNEGM KNHSV TKK LLEFYT GF E GVSTLVDVGG | 208 |
| SEQ ID NO:614 GI:18033964 | TAFEYHGTDP RFNRVFNEGM KNHSV TKK LLEFYT GF DE SVSTLVDVGG | 207 |

| | | | | | | |
|---|---|---|---|---|---|---|
| SEQ-ID-NO-647-GI-22652500 | GT GATLNMI | SKYPTI KGI N | FELPHVVEDA | PSHPGVEHVG | GDMFVSVPKL | 245 |
| SEQ-ID-NO-621-CLONE-1064285 | GVGATI RAVT | SKYPIH KGI N | FDLPHVI AEA | PQSPGVEHVA | GDMFKNVPS I | 252 |
| SEQ-ID-NO-616-GI-77818928 | GVGATVAAI T | AHYPTI KGI N | FDLPHVI SEA | PPFPGVT HVG | GDMFQKVPS I | 251 |
| SEQ-ID-NO-610-GI-4104224 | GVGATVAAI T | AHYPTI KGI N | FDLPHVI SEA | PPFPGVT HVG | GDMFKKVPL I | 256 |
| SEQ-ID-NO-622-GI-14578615 | GVGATVAAVV | AHYPAI KGVN | YDLPHVI SEA | PPFPGVT HVG | GDMFKEVPS I | 255 |
| SEQ-ID-NO-643-GI-125560205 | GVGATVAAI T | SRHPH RGI N | YDLPHVI SEA | PPFPGVEHVG | GDMFASVPRS | 256 |
| SEQ-ID-NO-644-GI-125602246 | GVGATVAAVV | SRHPH RGI N | FDLPHVI SEA | PPFPGVEHVG | GDMFASVPRG | 256 |
| SEQ-ID-NO-640-CLONE-1869486 | GI GATLHAI T | SHYPRI TGVN | FDLPHVI SEA | PPFPGVQHVG | GDMFKAVPA I | 256 |
| SEQ-ID-NO-613-GI-29839259 | GI GATLHAI T | SHHPQI KGI N | FDLPHVI SEA | PPFPGVQHVG | GDMFKSVPA I | 257 |
| SEQ-ID-NO-614-GI-18033964 | GI GATLHAI T | SHHSHI RGVN | FDLPHVI SEA | PPFPGVQHVG | GDMFKSVPA I | 256 |

| SEQ ID NO | | | | | | |
|---|---|---|---|---|---|---|
| SEQ-ID-NO-647-GI-22652500 | GDAIFMKWI C HDWSDDHCRK LRNCYQALP D-NGKVILAE CVLPEAPDT- | | | | | 293 |
| SEQ-ID-NO-621-CLONE-1064285 | GDAI VLKWI L HNWTDEHCTT LRNCYNALP A--HGKVVVVE G LPVEPEA- | | | | | 300 |
| SEQ-ID-NO-616-GI-77818928 | GDAI LMKWI L HDWSDEHCAT LKNCYDALP A--HGKVVLVE CILPVNPEA- | | | | | 299 |
| SEQ-ID-NO-610-GI-4104224 | GDAI LMKWI L HDWSDQHCGT LKNCYDALP M--HGKVVLVE CILPVNPEA- | | | | | 304 |
| SEQ-ID-NO-622-GI-14578615 | GDAI LMKWI L HDWSDQHCAT LKNCYDALP A--HGKVVLVE CILPVNPEA- | | | | | 303 |
| SEQ-ID-NO-643-GI-125560205 | GDAI LMKWI L HDWSDEHCAR LKNCYDALP E--HGKVVVVE CVLPESSDA- | | | | | 304 |
| SEQ-ID-NO-644-GI-125602246 | GDAI LMKWI L HDWSDEHCAR LKNCYDALP E--HGKVVVVE CVLPESSDA- | | | | | 304 |
| SEQ-ID-NO-640-CLONE-1869486 | GDAI LMKWI L HDWSCAHCAV LKNCYDALP A--GGKVIIVE CILPVNPEA- | | | | | 304 |
| SEQ-ID-NO-613-GI-29839259 | GDAI LMKWI L HDWSDAHCAT LKNCYDALP E--NGKVIIVE CVLPVNTEA- | | | | | 305 |
| SEQ-ID-NO-614-GI-18033964 | GDAI LMKWI L HDWSDAHCAT LKNCYDALP EKGGKVIIVE CVLPVTTDA- | | | | | 305 |

| | | | | | | |
|---|---|---|---|---|---|---|
| SEQ ID NO:647 GI:22652500 | SLATQNVHV | DVVMLAHNPG | GKERTEKEFE | ALAKGAGFKI | EFRK---VCSA | | 340 |
| SEQ ID NO:621 CLONE:1064285 | TSRGQQASLS | DMIMLTHTAG | GKERNQREFE | QLAKAAGFT-I | --AYIY | 347 |
| SEQ ID NO:616 GI:77818928 | TPKAQGVFHV | DMIMLAHNPG | GRERYEREYE | ALARGAGFA-I | AMKT---TYIY | 346 |
| SEQ ID NO:610 GI:4104224 | KPSSQGVFHV | DMIMLAHNPG | GRERYEREFE | ALARGAGFT-I | CFKS---TYIY | 351 |
| SEQ ID NO:622 GI:14578615 | KPSSQGVFHV | DMIMLAHNPG | GRERYEREYE | ALARGAGFA-I | GVKS---TYIY | 350 |
| SEQ ID NO:643 GI:125560205 | TAREQGVFHV | DMIMLAHNPG | GRERYEREFR | ELARAAGFT-I | GFKA---TYIY | 351 |
| SEQ ID NO:644 GI:125602246 | TAREQGVFHV | DMIMLAHNPG | GKERYEREFE | ELARAAGFT-I | GFKA---TYIY | 351 |
| SEQ ID NO:640 CLONE:1869486 | TPKAQGVFHA | DLIMLAHNPG | GKERYEREFR | ELAKGAGFT-I | GFKA---TYIY | 351 |
| SEQ ID NO:613 GI:29839259 | VPKAQGVFHV | DMIMLAHNPG | GRERYEREFH | DLAKGAGFS-I | GFKA---TYIY | 352 |
| SEQ ID NO:614 GI:18033964 | VPKAQGVFHV | DMIMLAHNPG | GRERYEREFR | DLAKAAGFS-I | GFKA---TYIY | 352 |

| SEQ ID NO: 647 GI: 226652500 | VNTW | I | ME | LC | — | 350 |
| --- | --- | --- | --- | --- | --- | --- |
| SEQ ID NO: 621 CLONE: 1064285 | SNTW | V | EL | T | K— | 357 |
| SEQ ID NO: 616 GI: 77818928 | ANAW | AI | EF | T | K— | 356 |
| SEQ ID NO: 610 GI: 4104224 | ANAW | AI | EF | T | K— | 361 |
| SEQ ID NO: 622 GI: 14578615 | ANAW | AI | EF | T | K— | 360 |
| SEQ ID NO: 643 GI: 125560205 | ANAW | AI | EF | T | K— | 361 |
| SEQ ID NO: 644 GI: 125602246 | ANAW | AI | EF | T | K— | 361 |
| SEQ ID NO: 640 CLONE: 1869486 | ANAW | AI | EF | T | K— | 361 |
| SEQ ID NO: 613 GI: 29839259 | ANAW | AI | EF | I | K— | 362 |
| SEQ ID NO: 614 GI: 18033964 | ANAW | AI | EF | I | K— | 362 |

| SEQ ID NO | GI | Sequence | |
|---|---|---|---|
| SEQ ID NO:727 | GI:29839288 | ----------MGS TG-ET QMTPT Q---VSDEEAH LFAMQLASAS | 30 |
| SEQ ID NO:762 | GI:7528266 | ----------MGS TG-ET QMTPT Q---VSDEEAH LFAMQLASAS | 30 |
| SEQ ID NO:693 | GI:114199044 | ----------MGS TP-ET QMTPT Q---VSDEEAN LFAMQLASAS | 30 |
| SEQ ID NO:697 | GI:3913295 | ----------MGS TG-ET QMTPT Q---VSDEEAN LFAMQLASAS | 30 |
| SEQ ID NO:692 | GI:6760443 | ----------MGS TG-ET QMTPT Q---VSDEEAN LFAMQLASAS | 30 |
| SEQ ID NO:754 | GI:29839344 | ----------MGS TG-ET QMTPT H---VSDEEAN LFAMQLASAS | 30 |
| SEQ ID NO:670 | GI:87887871 | ----------MGS TG-ET QMTPT Q---VSDEEAN LFAMQLASAS | 30 |
| SEQ ID NO:666 | GI:4574324 | ------------- ---MDEE I--L-GQADC KYMYGFVDS | 22 |
| SEQ ID NO:668 | GI:1777386 | ----M DSNMNGLAKS NGCEI SRDGF FE-SEEEELQ GQAEAWKCTF | 40 |
| SEQ ID NO:668 | GI:1777386 | ----M DSNMNGLAKS NGCEI SRDGF FE-SEEEELQ GQAEAWKCTF | 40 |

| | | | | | | | | |
|---|---|---|---|---|---|---|---|---|
| SEQ ID NO:727 GI:29839288 | VLP | — | MILKT | AIELDLLEIM | AKA | — | GAFLSTSEI | ASHLPITK | 69 |
| SEQ ID NO:762 GI:7528266 | VLP | — | MILKT | AIELDLLEIM | AKA | — | GAFLSTSEI | ASHLPITK | 69 |
| SEQ ID NO:693 GI:114199044 | VLP | — | MVLKA | AIELDLLEIM | AKA | — | GAFVSPADL | SSQLPITK | 69 |
| SEQ ID NO:697 GI:3913295 | VLP | — | MVLKA | AIELDLLEIM | AKA | — | GVFLSPTDI | ASQLPITK | 69 |
| SEQ ID NO:692 GI:6760443 | VLP | — | MVLKA | AIELDLLEIM | AKA | — | GSFLSPSDL | ASQLPITK | 69 |
| SEQ ID NO:754 GI:29839344 | VLP | — | MVLKA | AIELDLLEIM | AKA | — | GAFLSPNDL | ASQLPITK | 69 |
| SEQ ID NO:670 GI:87887871 | — | — | MTLRC | VVELGIPDII | HSH | GR | PITLTEI | LNGPNLS | 57 |
| SEQ ID NO:666 GI:4574324 | AFAESLAVKC | VVLLGIPDMI | ARE | GP | RATLSLGEI | VAKLPITE | 81 |
| SEQ ID NO:668 GI:1777386 | AFAESLAVKC | VVLLGIPDMI | ARE | GP | RATLSLCEI | VANLPITE | 81 |

| SEQ-ID-NO:727-GI:29839288 | KFLTKNEDG- | -VSVSPLCLM | NQDKVLMES- | WYYLKDAILE | CGI--PFNKAY | 158 |
|---|---|---|---|---|---|---|
| SEQ-ID-NO:762-GI:7528266 | KFLTKNEDG- | -VSVSPLCLM | NQDKVLMES- | WYYLKDAILE | CGI--PFNKAY | 158 |
| SEQ-ID-NO:693-GI:114199044 | KFLTKSVDG- | -ASIGSLCLM | NQDKVLMES- | WYNLKDAVLE | CGI--PFNKAY | 158 |
| SEQ-ID-NO:697-GI:3913295 | KFLTKNEEG- | -VSIAPLCLM | NQDKVLLES- | WYHLKDAVLE | CGI--PFNKAY | 158 |
| SEQ-ID-NO:692-GI:6760443 | KFLTKNEDG- | -VSIAALCLM | NQDKVLVES- | WYHLKDAVLD | CGI--PFNKAY | 158 |
| SEQ-ID-NO:754-GI:29839344 | KFLTKNEDG- | -VSIAALCLM | NQDKVLVES- | WYHLKDAVLD | CGI--PFNKAY | 158 |
| SEQ-ID-NO:670-GI:87887871 | CLLKDSK--- | -FNLAPFVLL | ETHPWITDP- | WNYLGKCVQE | GG-SGFVKAH | 147 |
| SEQ-ID-NO:666-GI:4574324 | KWLVKGRE-- | -LSMAPMLLM | QNDETTLAP- | WHHFNECVLE | GG--VAFQKAN | 168 |
| SEQ-ID-NO:668-GI:1777386 | KWLVKGRE-- | -LSMAPMLLM | QNDETTLAP- | WHHFNECVLE | GG--VAFQKAN | 167 |

| SEQ ID NO | Sequence | Pos |
|---|---|---|
| SEQ-ID-NO-727-GI-29839288 | GMTAFEYHG TDPRFNKVFN KGMSDHSTIT MKKILETYKG F EGLTSLV | 205 |
| SEQ-ID-NO-762-GI-7528266 | GMTAFEYHG TDPRFNKVFN KGMSDHSTIT MKKILETYKG F EGLTSLV | 205 |
| SEQ-ID-NO-693-GI-114199044 | GMTAFEYHG TDPRFNRVFN KGMADHSTIT MKKLLENYNG F EGLTSIV | 205 |
| SEQ-ID-NO-697-GI-3913295 | GMTAFEYHG TDPRFNKVFN RGMADHSTIT MKKILETYKG F EGLTSIV | 205 |
| SEQ-ID-NO-692-GI-6760443 | GMTAFDYHG TDPRFNKVFN KGMADHSTIT MKKILETYKG F EGLTSVV | 205 |
| SEQ-ID-NO-754-GI-29839344 | GMTAFDYHG TDPRFNKVFN KGMADHSTIT MKKILETYKG F EGLKSIV | 205 |
| SEQ-ID-NO-670-GI-87887871 | SDVFKFGS DHPEFFKLFL DGMECSTKVL VQVVLDKYQQ VF KDVKSIV | 195 |
| SEQ-ID-NO-666-GI-4574324 | GAEIWSYAS DHPDFNNLFN NAMACNARLV MKALSKYQG F HSLNSLV | 215 |
| SEQ-ID-NO-668-GI-1777386 | GAEIWSYAS DHPDFNNLFN NAMACNARLV MKALSKYQG F HSLNSLV | 214 |

| | | | | | |
|---|---|---|---|---|---|
| SEQ-ID-NO:727-GI:29839288 | DVGGGT GAVV | NT VSKYPSI | KGI NFDLPHV | EDAPSYPGV | EHVGGDMFVS | 255 |
| SEQ-ID-NO:762-GI:7528266 | DVGGGT GAVV | NT VSKYPSI | KGI NFDLPHV | EDAPSYPGV | EHVGGDMFVS | 255 |
| SEQ-ID-NO:693-GI:114199044 | DVGGGT GAVL | NMI VSKYPSI | KGI NFDLPHV | EDAPQYPGV | EHVGGDMFVS | 255 |
| SEQ-ID-NO:697-GI:3913295 | DVGGGT GAVL | NMI VSKYPSI | KGI NFDLPHV | EDAPQYPGV | EHVGGDMFVS | 255 |
| SEQ-ID-NO:692-GI:6760443 | DVGGGT GAVV | NMI VSKYPSI | KGI NFDLPHV | EDAPQYPGV | QHVGGDMFVS | 255 |
| SEQ-ID-NO:754-GI:29839344 | DVGGGT GAVV | NMI VSKYPSI | KGI NFDLPHV | EDAPQYPGV | QHVGGDMFVS | 255 |
| SEQ-ID-NO:670-GI:87887871 | DVGGGT GMM | SE VKNHPH | KGI NFDLPHV | VAEAPDYPGV | EHVGGDMFVE | 245 |
| SEQ-ID-NO:666-GI:4574324 | DVGGGT GTAV | AE VRAYPF | RGI NYDLPHV | VATASSLSGV | QHVGGDMFET | 265 |
| SEQ-ID-NO:668-GI:1777386 | DVGGGT GTAV | AE VRAYPF | RGI NYDLPHV | VATASSLSGV | QHVGGDMFET | 264 |

| | | | | | | |
|---|---|---|---|---|---|---|
| SEQ ID NO:727 GI:29839288 | VPN-ADAVFM | KWI CHDWSDA | HCLKFL KNCY | DALPEN-GKV | LVECI LPVA | 303 |
| SEQ ID NO:762 GI:7528266 | VPK-ADAVFM | KWI CHDWSDA | HCLKFL KNCY | DALPEN-GKV | LVECI LPVA | 303 |
| SEQ ID NO:693 GI:114199044 | VPK-GDAI FM | KWI CHDWSDE | HCLKFL KNCY | AALPDN-GKV | VAECI LPVA | 303 |
| SEQ ID NO:697 GI:3913295 | VPK-GDAI FM | KWI CHDWSDE | HCLKFL KNCY | AALPDN-GKV | LGECI LPVA | 303 |
| SEQ ID NO:692 GI:6760443 | VPK-GNAI FM | KWI CHDWSDE | HCI KFL KNCY | AALPDD-GKV | LAECI LPVA | 303 |
| SEQ ID NO:754 GI:29839344 | VPK-GDAI FM | KWI CHDWSDE | HCLKFL KNCY | AALPDN-GKV | LGECI LPVA | 303 |
| SEQ ID NO:670 GI:87887871 | LPQ-ADAI TM | KGI HDWNDD | ACVKI LENCK | KAI PKN-GKV | I DCVL--N | 291 |
| SEQ ID NO:666 GI:4574324 | VPT-CDAI FM | KWI MHDWNDE | DCI KI LKNCR | KAI PDT-GKV | I VDVVL DAD | 313 |
| SEQ ID NO:668 GI:1777386 | VPT-ADAI FM | KWI MHDWNDE | DCI KI LKNCR | KAI PDT-GKV | I VDVVL DAD | 312 |

| SEQ ID NO | Sequence | Position |
|---|---|---|
| SEQ:ID:NO:727·GI:29839288 | PDTSI-L-ATK------GV VHVDVI MLAH NPGGKERTEK EFEGL ANGAG | 343 |
| SEQ:ID:NO:762·GI:7528266 | PDTSI-L-ATK------GV VHVDVI MLAH NPGGKERTEK EFEGL ANGAG | 343 |
| SEQ:ID:NO:693·GI:1141199044 | PDSSI-L-ATK------GV VHI DAI MLAH NPGGKERTEQ EFEALAKGSG | 343 |
| SEQ:ID:NO:697·GI:3913295 | PDSSI-L-ATK------GV VHI DVI MLAH NPGGKERTEQ EFEALAKGSG | 343 |
| SEQ:ID:NO:692·GI:6760443 | PDTSI-L-ATK------GV VHMDVI MLAH NPGGKERTEQ EFQALAKGSG | 343 |
| SEQ:ID:NO:754·GI:29839344 | PDTSI-L-ATK------GV VHI DVVMLAH NPGGKERTEQ EFEALAKGSG | 343 |
| SEQ:ID:NO:670·GI:878877871 | PDCDDLFDD--------IK VVSDLGMRVH CSDGKERTEA EWEKLLKKGG | 332 |
| SEQ:ID:NO:666·GI:4574324 | QGDN-TDKKR KKAVDPIVGT V-FDLVMVAH SSGGKERSEK EWKRLLEGG | 361 |
| SEQ:ID:NO:668·GI:1777386 | QGDN-TDKKR KKAVDPIVGT V-FDLVMVAH SSGGKERTEK EWKRLLEGG | 360 |

| | | | | | |
|---|---|---|---|---|---|
| SEQ·ID·NO·727·GI·298392088 | FQ--GFE--VM----CCAFNTHVIE | ERKKA--- | 365 |
| SEQ·ID·NO·762·GI·7528266 | FQ--GFE--VM----CCAFNTHVIE | ------- | 360 |
| SEQ·ID·NO·693·GI·114199044 | FQ--GFR--VV----CSAFNTYAIE | FLKKN--- | 365 |
| SEQ·ID·NO·697·GI·3913295 | FQ--GFN--VA----CSAFNTYVIE | FLKKN--- | 365 |
| SEQ·ID·NO·692·GI·6760443 | FQ--GLR--VC----CDAFNTYVIE | FLKKI--- | 365 |
| SEQ·ID·NO·754·GI·298339344 | FQ--GLR--VA----CNAFNTYVIE | FLKKI--- | 365 |
| SEQ·ID·NO·670·GI·87887871 | FP--RYK--T----HVVTVQSMIE | AYPE--- | 353 |
| SEQ·ID·NO·666·GI·4574324 | FS--RYN--I----EIPALQSVIE | AFPR--- | 382 |
| SEQ·ID·NO·668·GI·1777386 | FS--RYN--I----EIPALQSVIE | AFPR--- | 381 |

| SEQ ID | Sequence | # |
|---|---|---|
| SEQ·ID·NO:355·GI:146217453 | ------GD GVL RNVA-------------------- | 317 |
| SEQ·ID·NO:368·GI:1002798 | DNNLWN VDDV MFL QQFSSCF-------------- | 333 |
| SEQ·ID·NO:375·GI:11526775 | --REAFEN SE MLL SDSF----------------- | 330 |
| SEQ·ID·NO:374·GI:30024600 | YNW----SE LFFEDPTTMH----------------- | 336 |
| SEQ·ID·NO:376·GI:22795039 | NFLKFE PDI LDVSNFM-- ELS------------- | 375 |
| SEQ·ID·NO:377·GI:30575840 | SMWKFE PDN LR NDFM------------------- | 340 |
| SEQ·ID·NO:373·CLONE-1711992 | SLD DT CFSAN AGMQSHCWI P-------------- | 320 |
| SEQ·ID·NO:371·CLONE-851672 | GYQQYHQQ GQ CI YGDSKAAA DAAAAQFDAH---- | 352 |
| SEQ·ID·NO:366·GI:33320067 | ENVTFDDSS D EDEFVDSEL I PCGI YTNVN GLGI NWCLN | 340 |
| SEQ·ID·NO:369·GI:547958 | ASF DFNL -EL EPYF------- SI DQLAWDC | 302 |
| SEQ·ID·NO:367·GI:1167486 | --ENGSI GCD HEI DPTTSN -NMGQI LSSF PSTL- | 331 |
| SEQ·ID·NO:356·GI:34147924 | --I M YLPRHLL--- SSFLFS------------- | 314 |
| SEQ·ID·NO:364·GI:92891589 | -EQFNL GE WDFFELMKDV SSSSFPFLDY QS--- | 319 |
| SEQ·ID·NO:363·GI:71041096 | DQEELTM GD WDLEDLMKDV --SSFPFLDF QVDG- | 343 |
| SEQ·ID·NO:359·GI:116831188 | -ENPKI GD WDLDGLIDNN --PSFPFLDF------ | 344 |
| SEQ·ID·NO:365·GI:39725413 | -ANLRI GE WDLEGLMDDL --TSFPLLDF------ | 321 |
| SEQ·ID·NO:342·ANNOT-1461478 | -ENLRM GE WDFEGLMENI --SSFPFLDF HVE-- | 333 |
| SEQ·ID·NO:358·ANNOT-1440199 | -ENVRM GE WDLEGLMENI --SSFPFLDF QVL-- | 327 |

| SEQ ID NO | GI | Sequence | Length |
|---|---|---|---|
| SEQ·ID·NO·420 | GI·2388664 | ---------------STAADMAA-------SADEDVA LFALQLASSS | 27 |
| SEQ·ID·NO·443 | GI·14578613 | ------------MG STAADMAA-------SADEEAC MFALQLASSS | 27 |
| SEQ·ID·NO·426 | GI·30385246 | ------------MG STAADMAA-------SADEEAC MYALQLASSS | 27 |
| SEQ·ID·NO·485 | GI·148337324 | ------------MG ST AA--------GADEDAC MYALQLVSSS | 23 |
| SEQ·ID·NO·468 | GI·125560205 | ------------MA A AA-------AADEEAC MYALQLVSSS | 20 |
| SEQ·ID·NO·469 | GI·115474869 | ------------MG STAADVAA-------VVDEEAC MYALQLASSS | 27 |
| SEQ·ID·NO·430 | GI·729135 | ------------MG STAGDVAA-------VVDEEAC MYAMQLASSS | 27 |
| SEQ·ID·NO·436 | GI·33641726 | ------------MG STAGDVAA-------VADEEAC MYAMQLASSS | 27 |
| SEQ·ID·NO·423 | GI·29839259 | ------------MG STAEDVAA-------VADEEAC MYAMQLASAS | 27 |
| SEQ·ID·NO·424 | GI·28569609 | ------------MG STAEDVAA-------VADEEAC MYAMQLASSS | 27 |

| SEQ-ID-NO-420-GI-2388664 | LPMT | KNAI | ELGL | LET | LVA | A | — | — | — | — | A | SL | — | TPT | EVAA | KLP | — | SAVNP | 68 |
|---|---|---|---|---|---|---|---|---|---|---|---|---|---|---|---|---|---|---|
| SEQ-ID-NO-443-GI-14578613 | LPMT | LKNAI | ELGL | LET | LVA | A | — | — | — | — | A | SL | — | TPT | EVAA | KLP | — | SAA—NP | 68 |
| SEQ-ID-NO-426-GI-30385246 | LPMT | LKNAI | ELGL | LEI | LVA | A | — | — | — | — | A | LL | — | TPA | EVAA | KLP | — | STA—NP | 68 |
| SEQ-ID-NO-485-GI-148337324 | LPMT | LKNAI | ELGL | LET | LVA | A | — | — | — | — | A | FL | — | TPA | EVAA | KLP | — | STA—NP | 64 |
| SEQ-ID-NO-468-GI-125560205 | LPMT | LKNAI | ELGL | LET | MS | A | — | — | — | GGK | A | AL | — | TPA | EVAE | KLP | — | SKA—NP | 68 |
| SEQ-ID-NO-469-GI-115474869 | LPMT | LKNAI | ELGL | LET | QS | AAV | AG | GGK | A | AL | — | TPA | EVAD | KLP | — | SKA—NP | | | 75 |
| SEQ-ID-NO-430-GI-729135 | LPMT | LKNAI | ELGL | LEV | LQK | AA | V | AG | GGK | A | AL | — | APE | EVVA | RMP | AAPS | DP | | 72 |
| SEQ-ID-NO-436-GI-33641726 | LPMT | LKNAI | ELGL | LEV | LQK | E | — | A | GGGKA | AL | — | APE | EVVA | RMP | AAPS | DP | | | 72 |
| SEQ-ID-NO-423-GI-29839259 | LPMT | LKNAI | ELGL | LEV | LQA | E | — | A | PAGK | A | AL | — | APE | EVVA | RLP | VAPT | NP | | 71 |
| SEQ-ID-NO-424-GI-28569609 | LPMT | LKNAL | ELGL | LEV | LQK | D | — | — | AGK | — | AL | — | AAE | EVVA | RLP | VAPT | NP | | 69 |

| SEQ ID NO | GI | Sequence | Length |
|---|---|---|---|
| SEQ:ID:NO:420 | GI:2388664 | -EAPDMVDRI LRLLASYNVV TCLV--EE-G KDGRLSRSYG AAPVCKFLTP | 114 |
| SEQ:ID:NO:443 | GI:14578613 | -EAPDMVDRM LRLLASYNVV TCLV--EE-G KDGRLSRSYG AAPVCKFLTP | 114 |
| SEQ:ID:NO:426 | GI:30385246 | -AAADMVDRM LRLLASYNVV SCTM--EE-G KDGRLSRRYG AAPVCKFLTP | 114 |
| SEQ:ID:NO:485 | GI:148337324 | -EAPDMVDRM LRLLASYKVV SCRT--EE-S KDGRLSRRYR AAPVCKYLTP | 110 |
| SEQ:ID:NO:468 | GI:125560205 | -AAADMVDRM LRLLASYNVV RCEM--EE-G ADGKLSRRYG AAPVCKWLTP | 114 |
| SEQ:ID:NO:469 | GI:115474869 | AAAAAMVDRM LRLLASYNVV RCQM--EE-G ADGKLSRRYA AAPVCKWLTP | 121 |
| SEQ:ID:NO:430 | GI:729135 | AAAADMVDRM LRLLASYDVV RCQM--ED-- RDGRYERRYS AAPVCKWLTP | 118 |
| SEQ:ID:NO:436 | GI:33641726 | -DAADMVDRM LRLLASYDVV RCQM--ED-- RDGRYERRYS AAPVCKWLTP | 118 |
| SEQ:ID:NO:423 | GI:29839259 | -AAADMVDRM LRLLASYDVV KCQM--ED-- KDGKYERRYS AAPVGKWLTP | 116 |
| SEQ:ID:NO:424 | GI:28569609 | -AAADMVDRM LRLLASYDVV RCQM--ED-- KDGKYERRYS AAPVGKWLTP | 114 |

| SEQ:ID:NO:420:GI:2388664 | NEDGVSMAAL | ALMNQDKVLM | ES-WYYLKDA | VLD---GGIP- | FNKAY-GMSA | 159 |
|---|---|---|---|---|---|---|
| SEQ:ID:NO:443:GI:14578613 | NEDGVSMAAL | ALMNQDKVLM | ES-WYYLKDA | VLD---GGIP- | FNKAY-GMSA | 159 |
| SEQ:ID:NO:426:GI:30385246 | NEDGVSMAAL | ALMNQDKVLM | ES-WYYLKDA | VLD---GGIP- | FNKAY-GMSA | 159 |
| SEQ:ID:NO:485:GI:148337324 | NEDGVSMSAL | ALMNQDKVLM | ES-WYYLKDA | VLD---GGIP- | FNKAY-GMSA | 155 |
| SEQ:ID:NO:468:GI:125560205 | NEDGVSMAAL | ALMNQDKVLM | ES-WYYLKDA | VLD---GGIP- | FNKAY-GMSA | 159 |
| SEQ:ID:NO:469:GI:115474869 | NEDGVSMAAL | ALMNQDKVLM | ES-WYYLKDA | VLD---GGIP- | FNKAY-GMTA | 166 |
| SEQ:ID:NO:430:GI:729135 | NEDGVSMAAL | ALMNQDKVLM | ES-WYYLKDA | VLD---GGIP- | FNKAY-GMTA | 163 |
| SEQ:ID:NO:436:GI:33641726 | NEDGVSMAAL | ALMNQDKVLM | ES-WYYLKDA | VLD---GGIP- | FNKAY-GMTA | 163 |
| SEQ:ID:NO:423:GI:29839259 | NEDGVSMAAL | TLMNQDKVLM | ES-WYYLKDA | VLD---GGIP- | FNKAY-GMTA | 161 |
| SEQ:ID:NO:424:GI:28569609 | NEDGVSMAAL | ALMNQDKVLM | ES-WYYLKDA | VLD---GGIP- | FNKAY-GMTA | 159 |

| SEQ ID | | | | | | | | | |
|---|---|---|---|---|---|---|---|---|---|
| SEQ-ID-NO-420-GI-2388664 | FEYHGT DPRF | NRVF NE GMKN | HSI | TKKL L | EL Y-HGF | -QG | LGT | LVDV GGG | 207 |
| SEQ-ID-NO-443-GI-14578613 | FEYHGT DPRF | NRVF NE GMKN | HSI | TKKL L | EL Y-HGF | -QG | LGT | LVDV GGG | 207 |
| SEQ-ID-NO-426-GI-30385246 | FEYHGT DPRF | NRVF NE GMKN | HSI | TKKL L | EV Y-KGF | -EG | LGT | I VDV GGG | 207 |
| SEQ-ID-NO-485-GI-148337324 | FEYHGT DPRF | NRVF NE GMKN | HSI | TKKL L | ES Y-KGF | -EG | LGT | LVDV GGG | 203 |
| SEQ-ID-NO-468-GI-125560205 | FEYHGT DARF | NRVF NE GMKN | HSI | TKKL L | DL Y-T GF | -DA | AST | VVDV GGG | 207 |
| SEQ-ID-NO-469-GI-115474869 | FEYHGT DARF | NRVF NE GMKN | HSI | TKKL L | DL Y-T GF | -DA | AST | VVDV GGG | 214 |
| SEQ-ID-NO-430-GI-729135 | FEYHGT DARF | NRVF NE GMKN | HSV | TKKL L | DF Y-T GF | -EG | VST | LVDV GGG | 211 |
| SEQ-ID-NO-436-GI-33641726 | FEYHGT DARF | NRVF NE GMKN | HSV | TKKL L | EF Y-T GF | -EG | VST | LVDV GGG | 211 |
| SEQ-ID-NO-423-GI-29839259 | FEYHGT DPRF | NRVF NE GMKN | HSV | TKKL L | EF Y-T GF | -EG | VST | LVDV GGG | 209 |
| SEQ-ID-NO-424-GI-28569609 | FEYHGT DPRF | NRVF NE GMKN | HSV | TKKL L | EF Y-T GF D | ES | VST | LVDV GGG | 208 |

| | | | | | | |
|---|---|---|---|---|---|---|
| SEQ-ID-NO-420-GI-23888664 | VGATVAAI | AA | HYPAI | -KCVN | FDLPHVI | SEA | PQFPGVTHVG | GDMFKEVPI-S | 255 |
| SEQ-ID-NO-443-GI-14578613 | VGATVAAI | AA | HYPAI | -KCVN | FDLPHVI | SEA | PQFPGVTHVG | GDMFKEVPI-S | 255 |
| SEQ-ID-NO-426-GI-30385246 | VGATVGAI | TA | AYPAI | -KGI N | FDLPHVI | SEA | QPFPGVTHVG | GDMFQKVPI-S | 255 |
| SEQ-ID-NO-485-GI-148337324 | VGATVGAI | IA | RYPAV | -KGI N | FDLPHVI | SEA | PAFPGVTHI G | GDMFQKVPI-S | 251 |
| SEQ-ID-NO-468-GI-1255560205 | VGATVAAVVS | TS | RHPHI | -RGI N | YDLPHVI | SEA | PPFPGVEHVG | GDMFASVPRS | 256 |
| SEQ-ID-NO-469-GI-115474869 | VGATVAAVVS | TS | RHPHI | -RGI N | YDLPHVI | SEA | PPFPGVEHVG | GDMFASVPRG | 263 |
| SEQ-ID-NO-430-GI-729135 | VGATLHAI | TS | RHPHI | -SCVN | FDLPHVI | SEA | PPFPGVRHVG | GDMFASVP-A | 259 |
| SEQ-ID-NO-436-GI-33641726 | VGATLHAI | TS | RHPQI | -SGVN | FDLPHVI | SEA | PPFPGVRHVG | GDMFASVP-A | 259 |
| SEQ-ID-NO-423-GI-29839259 | I GATLHAI | TS | HHPQI | -KGI N | FDLPHVI | SEA | PPFPGVQHVG | GDMFKSVP-A | 257 |
| SEQ-ID-NO-424-GI-28569609 | I GATLHAI | TS | HHSHI | -RGI N | FDLPHVI | SEA | PPFPGVQHVG | GDMFKSVP-A | 256 |

| | | | | | | |
|---|---|---|---|---|---|---|
| SEQ ID NO:420 GI:2388664   | GDAI LMKWI L | HDWSDQHCAT | LKNCYDALP | AN-GKVVLVE | CIL L-PVNPEA | 303 |
| SEQ ID NO:443 GI:14578613  | GDAI LMKWI L | HDWSDQHCAT | LKNCYDALP | AH-GKVVLVE | CIL L-PVNPEA | 303 |
| SEQ ID NO:426 GI:30385246  | GDAI LMKWI L | HDWSDEHCAT | LKNCYDALP | AH-GKVVLVE | CIL L-PVNPEA | 303 |
| SEQ ID NO:485 GI:148337324 | GDAI LMKWI L | HDWSDEHCAT | LKNCYDALP | AH-GKVVLVE | CIL L-PVNPEA | 299 |
| SEQ ID NO:468 GI:125560205 | GDAI LMKWI L | HDWSDEHCARAT | LKNCYDALP | EH-GKVVVVE | CVL L-PESSDA | 304 |
| SEQ ID NO:469 GI:115474869 | GDAI LMKWI L | HDWSDEHCAT | LKNCYDALP | EH-GKVVVVE | CVL L-PESSDA | 311 |
| SEQ ID NO:430 GI:729135    | GDAI LMKWI L | HDWSDAHCAT | LKNCYDALP | EN-GKVI VVE | CVL L-PVNTEA | 307 |
| SEQ ID NO:436 GI:33641726  | GDAI LMKWI L | HDWSDAHCAT | LKNCYDALP | EN-GKVI VVE | CVL L-PVNTEA | 307 |
| SEQ ID NO:423 GI:29839259  | GDAI LMKWI L | HDWSDAHCAT | LKNCYDALP | EN-GKVI I VE | CVL L-PVNTEA | 305 |
| SEQ ID NO:424 GI:28569609  | GDAI LMKWI L | HDWSDAHCAT | LKNCYDALP | EKGGKVI VVE | CVL L-PVTTDA | 305 |

| SEQ ID NO | | | | | | | |
|---|---|---|---|---|---|---|---|
| SEQ·ID·NO·420·GI·23886664 | NPSS–QGVFH | – – – | – – – | MLAHNPGGR | ERYEREFQAL | ARGAGF–TGV | 344 |
| SEQ·ID·NO·443·GI·14578613 | KPSS–QGVFH | – – – | VDM | MLAHNPGGR | ERYEREFEAL | ARGAGF–TGV | 344 |
| SEQ·ID·NO·426·GI·303885246 | TPKA–QGVFH | – – – | VDM | MLAHNPGGR | ERYEREFEAL | AKGAGF–KAI | 344 |
| SEQ·ID·NO·485·GI·148337324 | TPEV–QGVFH | – – – | VDM | MLAHNPGGR | ERYEREFEAL | AKGAGF–AAM | 340 |
| SEQ·ID·NO·468·GI·255560205 | TARE–QGVFH | – – – | VDM | MLAHNPGGK | ERYEREFREL | ARAAGF–TGF | 345 |
| SEQ·ID·NO·469·GI·154474869 | TARE–QGVFH | – – – | VDM | MLAHNPGGK | ERYEREFREL | ARAAGF–TGF | 352 |
| SEQ·ID·NO·430·GI·729135 | TPKA–QGVFH | – – – | VDM | MLAHNPGGK | ERYEREFREL | AKGAGF–SGF | 348 |
| SEQ·ID·NO·436·GI·33641726 | TPKA–QGVFH | – – – | VDM | MLAHNPGGR | ERYEREFREL | AKGAGF–SGF | 348 |
| SEQ·ID·NO·423·GI·29839259 | VPKA–QGVFH | – – – | VDM | MLAHNPGGR | ERYEREFHDL | AKGAGF–SGF | 346 |
| SEQ·ID·NO·424·GI·28569609 | VPKA–QGVFH | – – – | VDM | MLAHNPGGR | ERYEREFRDL | AKAAGF–SGF | 346 |

| Seq ID | Sequence | Position |
|---|---|---|
| SEQ ID NO:420 GI:2388664   | YANAW-A EF | 358 |
| SEQ ID NO:443 GI:14578613  | YANAW-A EF | 358 |
| SEQ ID NO:426 GI:30385246  | YANAW-A EF | 358 |
| SEQ ID NO:485 GI:148337324 | YANAF-A EF | 354 |
| SEQ ID NO:468 GI:125560205 | YANAW-A EF | 359 |
| SEQ ID NO:469 GI:115474869 | YANAW-A EF | 366 |
| SEQ ID NO:430 GI:729135    | YANAW-A EF | 362 |
| SEQ ID NO:436 GI:33641726  | YANAW-A EF | 358 |
| SEQ ID NO:423 GI:29839259  | YANAW-A EF | 360 |
| SEQ ID NO:424 GI:28569609  | YANAW-A EF | 360 |

Figure 19T

| SEQ ID | Sequence | Position |
|---|---|---|
| SEQ-ID-NO-461-GI-6688808 | QK--- | 358 |
| SEQ-ID-NO-465-CLONE-1917412 | NK--- | 355 |
| SEQ-ID-NO-379-GI-4574324 | PR--- | 382 |
| SEQ-ID-NO-471-GI-1669591 | YK--- | 367 |
| SEQ-ID-NO-409-CLONE-535888 | FK--- | 358 |
| SEQ-ID-NO-488-GI-145695037 | YK--- | 353 |
| SEQ-ID-NO-344-ANNOT-1520476 | IKK--- | 356 |
| SEQ-ID-NO-390-ANNOT-1475680 | IDYDLAQL | 435 |
| SEQ-ID-NO-378-GI-56605372 | HK--- | 364 |
| SEQ-ID-NO-451-GI-38047397 | HK--- | 364 |
| SEQ-ID-NO-475-GI-45444737 | NK--- | 365 |
| SEQ-ID-NO-447-GI-133902310 | EKRAIY--- | 358 |
| SEQ-ID-NO-383-GI-133902324 | EKRAIY--- | 358 |
| SEQ-ID-NO-448-GI-133902303 | EKRAIY--- | 358 |
| SEQ-ID-NO-382-GI-33286376 | YKN--- | 360 |
| SEQ-ID-NO-478-GI-4808530 | CK--- | 362 |
| SEQ-ID-NO-449-GI-7271883 | CKTA--- | 386 |
| SEQ-ID-NO-450-GI-29839290 | CK--- | 354 |
| SEQ-ID-NO-393-GI-15239571 | LKKL--- | 363 |
| SEQ-ID-NO-397-CLONE-1128033 | LKKI--- | 362 |
| SEQ-ID-NO-458-GI-24212064 | SKQICN--- | 343 |
| SEQ-ID-NO-418-GI-5732000 | LKKI--- | 367 |
| SEQ-ID-NO-454-GI-1582580 | LKKP--- | 365 |
| SEQ-ID-NO-410-GI-116908 | LKKV--- | 365 |
| SEQ-ID-NO-411-GI-92878636 | LKKV--- | 365 |
| SEQ-ID-NO-412-GI-1169009 | LKTA--- | 365 |
| SEQ-ID-NO-462-GI-3913289 | LKTA--- | 366 |
| SEQ-ID-NO-484-GI-109255537 | LKKP--- | 370 |
| SEQ-ID-NO-391-GI-7352271 | RKN--- | 365 |
| SEQ-ID-NO-388-GI-231757 | RKKA--- | 364 |
| SEQ-ID-NO-452-GI-29839288 | RKKA--- | 365 |
| SEQ-ID-NO-486-GI-7528266 | --- | 365 |
| SEQ-ID-NO-407-GI-3913295 | LKKN--- | 360 |
| SEQ-ID-NO-402-GI-6760443 | LKKI--- | 365 |
| SEQ-ID-NO-477-GI-29839344 | LKKI--- | 365 |
| SEQ-ID-NO-472-GI-385655551 | YK--- | 365 |
| SEQ-ID-NO-414-GI-120003964 | HK--- | 365 |
| SEQ-ID-NO-416-GI-396589 | N--- | 359 |
| SEQ-ID-NO-456-GI-97974173 | CK--- | 364 |
| SEQ-ID-NO-466-GI-29839421 | LK--- | 364 |
| SEQ-ID-NO-413-GI-29839377 | LK--- | 361 |
| SEQ-ID-NO-474-GI-29839361 | CK--- | 363 |
| SEQ-ID-NO-419-GI-27531337 | TK--- | 350 |
| | | 352 |

| | | | | | |
|---|---|---|---|---|---|
| SEQ-ID-NO-772-GI-7414433 | KAIATYAMNA | YYQANGKHDY | NCDFSHSGVT | TSVNPSHDNC | RI---- | 453 |
| SEQ-ID-NO-771-GI-92867830 | VAHASFAFNS | YYQKQARAGG | SCYFGGTSYV | VTQEPKYGKC | EFPTGY | 470 |
| SEQ-ID-NO-773-GI-11071974 | EAHASYAFNS | YYQKNTRGVS | TCDFSGAAYV | VTQHPKYGSC | KFPTGY | 467 |
| SEQ-ID-NO-775-GI-33321023 | VAAFLAMVSG | LC----- | ---- | ---- | ---- | 422 |
| SEQ-ID-NO-776-GI-33321014 | AAAVLAMVSG | PC----- | ---- | ---- | ---- | 431 |
| SEQ-ID-NO-780-CLONE-1876038 | ACVVVLVMQL | WL----- | ---- | ---- | ---- | 423 |
| SEQ-ID-NO-781-GI-125531206 | SALLLMLHN | FYVL---- | ---- | ---- | ---- | 416 |
| SEQ-ID-NO-783-GI-22655795 | KSVVFIMLGA | FANTRNVKA- | ---- | ---- | ---- | 418 |
| SEQ-ID-NO-281-CLONE-11988 | FFFLLCI1KL | RL----- | ---- | ---- | ---- | 425 |
| SEQ-ID-NO-778-CLONE-1145901 | FFFLLCI1KL | RL----- | ---- | ---- | ---- | 425 |
| SEQ-ID-NO-770-ANNOT-1467144 | LLFPLLLNY | LAFRLAF-- | ---- | ---- | ---- | 409 |
| SEQ-ID-NO-774-GI-419789 | VSILASSFSL | FL----- | ---- | ---- | ---- | 402 |

| SEQ ID NO | Sequence | | | | | |
|---|---|---|---|---|---|---|
| SEQ-ID-NO-806-GI-73759951 | ASQKIDLDVI | KDIDLYR-EP | WDL-ERCRIG | YEEQNEWYFF | SHKDKKYPTG | 83 |
| SEQ-ID-NO-814-GI-78499704 | ASQKIDLDVI | REIDLYK-EP | WDLQERCKIG | Y-EQKEWYFF | SHKDKKYPTG | 81 |
| SEQ-ID-NO-801-GI-66275774 | ASMPSPVPI- | AEVNIYKCNP | WDLPGKALFG | ----ENEWYFF | SPRDRKYPNG | 82 |
| SEQ-ID-NO-809-CLONE-1824711 | SSLPCPYPI- | AEVNIYQCNP | WDLPAKALFG | ----EEEWYFF | SPRDRKYPNG | 79 |
| SEQ-ID-NO-795-GI-87241197 | KSRPLPASI- | AEIDLYKFNP | WELPKKSLFG | ----EEEWYFF | SPRDRKYPNG | 83 |
| SEQ-ID-NO-805-GI-117586720 | ASSPCPAS-- | AEVDLYK-DP | WDLPEKALFG | ----DREWYFF | TPRDRKYPNG | 77 |
| SEQ-ID-NO-799-GI-6730938 | ARQPLPVP-- | AEIDLYKFDP | WDLPEKALFG | ----RKEWYFF | TPRDRKYPNG | 88 |
| SEQ-ID-NO-810-GI-82400207 | ACQRLPVP-- | AEIDLYKFDP | WDLPEKALFG | ----LKEWYFF | SPRDRKYPNG | 83 |
| SEQ-ID-NO-800-GI-58013003 | ASLPIAVPI- | AEIDLYKFDP | WQLPRMALYG | ----EKEWYFF | SQEDRKYPNG | 79 |
| SEQ-ID-NO-796-GI-57233056 | AGQSISVSL- | AEIDLYKFDP | WQLPEKALYG | ----EKEWYFF | SPRDRKYPNG | 82 |
| SEQ-ID-NO-813-GI-154362215 | AGQQIGVPV- | AEIDLYKFDP | WDLPDLALYG | ----EKEWYFF | SPRDRKYPNG | 79 |
| SEQ-ID-NO-798-GI-211105748 | ASQPIAVPI- | AEIDLYKFDP | WELPGLALYG | ----EKEWYFF | SPRDRKYPNG | 77 |
| SEQ-ID-NO-790-GI-31322578 | ASQSISVPI- | AEIDLYKYDP | WDLPGLALYG | ----EKWYFF | SPRDRKYPNG | 75 |
| SEQ-ID-NO-815-GI-82568708 | QSQPISMPI- | AEIDLYKYNP | WELPEKATFG | ----EQEWYFF | SPRDRKYPNG | 77 |
| SEQ-ID-NO-804-GI-115336267 | AKVPLPVT-- | TEVDLYKFDP | WELPEKATFG | ----EQEWYFF | SPRDRKYPNG | 97 |
| SEQ-ID-NO-807-GI-115336269 | AKVPLPVT-- | AEVDLYKFDP | WELPEKATFG | ----EQEWYFF | SPRDRKYPNG | 97 |
| SEQ-ID-NO-284-CLONE-21243 | DSVPLPVA-- | ADVDLYKFDP | WELPAKASFG | ----EQEWYFF | SPRDRKYPNG | 86 |
| SEQ-ID-NO-789-GI-20466640 | DSVPLPVA-- | ADVDLYKFDP | WELPAKASFG | ----AEEWYFF | SPRDRKYPNG | 86 |
| SEQ-ID-NO-794-CLONE-467981 | DSVPLPVSI- | ADVDLYKFDP | WELPAKASFG | ----EQEWFFF | SPRDRKYPNG | 86 |
| SEQ-ID-NO-797-GI-52353036 | AGAPIPVD-- | GEIDLYKFDP | WELPAKAIFG | ----EREWYFF | SPRERKYPNG | 85 |
| SEQ-ID-NO-788-CLONE-1848247 | TSAPLPVA-- | AEVDLYKFDP | WELPAKATFG | ----EQEWYFF | SPRDRKYPNG | 84 |
| SEQ-ID-NO-792-GI-63252923 | TSAPLPVA-- | AEIELYKFDP | WELPAKAITFG | ----EQEWYFF | SPRDRKYPNG | 95 |

| | | | | | |
|---|---|---|---|---|---|
| SEQ-ID-NO-806-GI-73759951 | ---RA[T]G[Q]TR | TTPAWE[S]NYF | LDESSLLTST | MDDYTTIQPS | NIPLT[S]SFMC | 207 |
| SEQ-ID-NO-814-GI-78499704 | -RS[T]VPTK | RRQ------ | ---------- | ---------R | LWDPNCFFYD | 181 |
| SEQ-ID-NO-801-GI-66275774 | ---CNNLHNF | SSSDQ[E]QEHE | QESSTTVEDS | ---------H | NNHTVS[S]PKS | 206 |
| SEQ-ID-NO-809-CLONE-1824711 | ---SNNF[Q]LS | DQDQE[C]STVE | EESLNNKMNG | TITASPKSEA | NNDGHDHQF[H] | 211 |
| SEQ-ID-NO-795-GI-87241197 | ---GY[S]L[K]NL | SENQE[N]PSEP | TIPLNLPR-- | ---------G | EERPT[N]VNLR | 204 |
| SEQ-ID-NO-805-GI-117586720 | ---S[N]HLSPT | EMDQEQ--ED | PCGEETCFPA | MQNQMMPMNH | GMKLQKVSSI | 210 |
| SEQ-ID-NO-799-GI-67309938 | ---K[N]NW[E]KV | KLEQQ[D]VASV | A--------- | ---------A | AAPRN[H]HHQN | 202 |
| SEQ-ID-NO-810-GI-82400207 | ---K[N]T[W]E-- | ---------- | ---------- | ---------K | MQQQKEAAS[F] | 183 |
| SEQ-ID-NO-800-GI-58013003 | ---KGGL[E]KP | AA-------- | ---------- | ---------A | SSGDHKPMVF | 180 |
| SEQ-ID-NO-796-GI-57233056 | ---KGHTLRS | I--------- | ---------- | ---------T | MWASKRGES[F] | 182 |
| SEQ-ID-NO-813-GI-154362215 | ---KG[T]L[E]KH | LSVD[Q]K[E]VQF | SDSE------ | ---------E | QKPEV[D]AFP[E] | 192 |
| SEQ-ID-NO-798-GI-211105748 | ---KGS[I]EKN | QL-------- | ---------- | ---------N | NKKIM[N]T SYM | 179 |
| SEQ-ID-NO-790-GI-31322578 | ---KGA[I]E-- | ---------- | ---------- | ---------K | RGPPPTPVV[Y] | 175 |
| SEQ-ID-NO-815-GI-82568708 | ---KG[I]V[E]KQ | QQQQQQ---- | ---------- | ---------Q | QQQTT[S]RMSS | 183 |
| SEQ-ID-NO-804-GI-1155336267 | NKAAAGDQQR | SMECED[S]VED | AVTAY--PLY | ATAC------ | TGAGA[H]GSN[Y] | 237 |
| SEQ-ID-NO-807-GI-1155336269 | NKAAAGDQQR | SMECED[S]VED | AVTAYPPYAT | AG-------M | TGAGA[H]GSN[Y] | 237 |
| SEQ-ID-NO-284-CLONE-21243 | ---[N]N[S]TASR | HHHHLH---- | ---------- | ---------H | IHLDND[H]HR[H] | 201 |
| SEQ-ID-NO-789-GI-20466640 | ---[N]N[S]TASR | HHHHLH---- | ---------- | ---------H | IHLD[N]D[H]HR[H] | 201 |
| SEQ-ID-NO-794-CLONE-467981 | ----GNTQR | SHERD[D]SIDD | MIGEV--PPS | INVGHMSA-R | FHLSRMSTS[Y] | 218 |
| SEQ-ID-NO-797-GI-52353036 | ---[N]NTQRSI | DDLHDMLGSI | PQNVPN---- | ---------S | ILQGIKPSN[Y] | 213 |
| SEQ-ID-NO-788-CLONE-1848247 | ---[N]NTNRPL | GYEKDE[A]MDD | MGGPV--PTS | ---------S | LQFQTKGTSC | 216 |
| SEQ-ID-NO-792-GI-63252923 | ---[N]NSHRPM | DLERED[S]MED | MMGPLMPPSI | SHVGHHQNMN | LHLPK[S]NTN[Y] | 234 |

Figure 21E

| SEQ ID NO | Sequence | # |
|---|---|---|
| SEQ·ID·NO:806·GI:73759951 | KQELEASENL NFIHCDQFI- ---------- ---------- -------Q LPHLESPSLQ | 237 |
| SEQ·ID·NO:814·GI:78499704 | ATLLEPLDK- ---------- ---------- ---------- -----NV LKRAKHNTDF | 202 |
| SEQ·ID·NO:801·GI:66275774 | EAFDGDGDD- ---------- ---------- ---------- ------ -QLQLQQFR | 223 |
| SEQ·ID·NO:809·CLONE·18247 11 | PTTMAMNKSY SITDLLNTID YS-------- ---------- -------AL SQLLDAPAEP | 245 |
| SEQ·ID·NO:795·GI:87241197 | SDITDYQF- ---------- ---------- ---------- ---------- -KDYQIIASI | 222 |
| SEQ·ID·NO:805·GI:117586720 | SEFLQEYSP- LLNLFDNQ-- ---------- ---------- ---------- ---QEIPRFD | 234 |
| SEQ·ID·NO:799·GI:6730938 | GEVMDAAAA- ---------- ---------- ---------- ---------- ---------- | 211 |
| SEQ·ID·NO:810·GI:82400207 | GETMDSVDD- ---------- ---------- ---------- ---------- ---------- | 192 |
| SEQ·ID·NO:800·GI:58013003 | AAGAVSSPP- ---------- ---------- ---------- ---------- ---EQKPFVA | 196 |
| SEQ·ID·NO:796·GI:57233056 | GEFEDEI KP- ---------- ---------- ---------- ---------- -KIFPTQLAP | 200 |
| SEQ·ID·NO:813·GI:154362215 | GDMVMPGPA- ---------- ---------- ---------- ---------- ---------- | 201 |
| SEQ·ID·NO:798·GI:21105748 | DMTVSSEED- ---------- ---------- ---------- ---------- --RKPEIL | 194 |
| SEQ·ID·NO:790·GI:31322578 | GDEVVEEKP- ---------- ---------- ---------- ---------- -----RLS | 187 |
| SEQ·ID·NO:815·GI:82568708 | GSEFEDRKP- ---------- ---------- ---------- ---------- ------ENL | 195 |
| SEQ·ID·NO:804·GI:115336267 | DSLLHHQDSH EDNFLDGLL- ---------- ------TAE DAGLSAGPTS LSHLAAARA | 279 |
| SEQ·ID·NO:807·GI:115336269 | DSLLHHQDSH EDNFLDGLL- ---------- ------TAE DAGLSAGATS LSHLAAARA | 279 |
| SEQ·ID·NO:284·CLONE·21243 | DMMIDDDRF- ---------- ---------- ---------- ---------- ------RHV | 213 |
| SEQ·ID·NO:789·GI:20466640 | DMMIGDDDRF- ---------- ---------- ---------- ---------- ------RHV | 213 |
| SEQ·ID·NO:794·CLONE·467981 | SGALLENDR- --NTLEGVVI GNGSVNGISN ---------- TNNITSVISS SHQFGTSNSK | 265 |
| SEQ·ID·NO:797·GI:52353036 | GTILLENES- --NMYDGI-- ---------- ---------- ------M NNTNDI-NNN | 239 |
| SEQ·ID·NO:788·CLONE·1848247 | GTFLENHEH- --NLFDGML- --GSDGMNNN G--------- ------SM SHLGRCSSSK | 253 |
| SEQ·ID·NO:792·GI:63252923 | GPPFIENDQ- --IIFDGIM- ---------- ---------- ---------- -SSTDGSASL | 259 |

| | | | | | |
|---|---|---|---|---|---|
| SEQ·ID·NO·806·GI·73759951 | ----GCDKGG | KLNGFLSSTS | SDHFDV-GIC | IFDKL---- | 357 |
| SEQ·ID·NO·814·GI·78499704 | ---------- | ---------- | ---------- | ---------- | 283 |
| SEQ·ID·NO·801·GI·66275774 | GMKRKRSSGS | LMCSQLQLPA | DQYSGM-LIH | PFLSQQLHM- | 359 |
| SEQ·ID·NO·809·CLONE·1824711 | TTSSYCNQQL | VDTSGF---- | -QHSSL-LSY | PFLEMQ---- | 367 |
| SEQ·ID·NO·795·GI·87241197 | ---------- | ---------- | -DFQKL-NKF | TFTERYQQ-- | 323 |
| SEQ·ID·NO·805·GI·117586720 | -----QYG | LLSQPF---- | -FSQQL-LMN | SNTGSLH--- | 339 |
| SEQ·ID·NO·799·GI·6730938 | VNPAAPGHDG | GYLQSI---- | -SSPQMKMWQ | TILPPF---- | 316 |
| SEQ·ID·NO·810·GI·82400207 | ----MSDHDY | YYS------- | -NLPQLRSNQ | SDLLPF---- | 303 |
| SEQ·ID·NO·800·GI·58013003 | -------GG | HAGDP----- | -LLQDI-LMY | WGKPF---- | 296 |
| SEQ·ID·NO·796·GI·57233056 | ---IQMQQQN | CNIDQEN--- | -TFQDM-FLY | MQKP----- | 307 |
| SEQ·ID·NO·813·GI·154362215 | -----PFGSQM | QYGDQLS--- | -LFPDM-YAY | MQKPF---- | 303 |
| SEQ·ID·NO·798·GI·211105748 | ----DNSLLGS | QFQSSYQMS- | -PLQDM-FMH | LHKPF---- | 304 |
| SEQ·ID·NO·790·GI·313322578 | ----AFGGGG | GSNQLF---- | -PLQDM-FMY | NMPKPY--- | 285 |
| SEQ·ID·NO·815·GI·82568708 | -------GP | QFQSANQMS- | -PLQDI-FMY | LQKPY---- | 295 |
| SEQ·ID·NO·804·GI·115336267 | CAPLAPEATA | AATSAF-QHPV | -QJSGV-NWN | P-------- | 396 |
| SEQ·ID·NO·807·GI·115336269 | GAPLAPEATA | AATSAF---- | ---------- | ---------- | 383 |
| SEQ·ID·NO·284·CLONE·21243 | ATPLMQNQGG | IY-------- | -QLPGL-NWY | S-------- | 320 |
| SEQ·ID·NO·789·GI·20466640 | ATPLMQNQGG | ---------- | -QLPGL-NWY | S-------- | 320 |
| SEQ·ID·NO·794·CLONE·467981 | -----DG | LLRTPY---- | -QLQGT-NWY | G-------- | 360 |
| SEQ·ID·NO·797·GI·52353036 | G---SLNDGV | VFRQPYN--- | -QVTGM-NWY | S-------- | 355 |
| SEQ·ID·NO·788·CLONE·1848247 | ----GSMEDG | IFRPSY---- | -QLPGL-NWY | TLN------ | 349 |
| SEQ·ID·NO·792·GI·63252923 | ----GSLGDG | LFRTPY---- | -QLPGM-NWF | SESNLG--- | 363 |

Figure 21I

| | | | | | | |
|---|---|---|---|---|---|---|
| SEQ-ID-NO-289-CLONE-41046 | --MDLL----- | --LEKSLIAV | FVAVILATVI | SKLRGKKLKL | PPGPIPIPIF | 43 |
| SEQ-ID-NO-816-GI-54634694 | MGSEVLAQGS | ALLEKSLIAL | LVVVGAVLV | NKLRGRKLKL | PPGPFALPIF | 50 |
| SEQ-ID-NO-820-GI-38322956 | MEIMTVAS | --LEKGLLAI | FAMIVGAIFL | SKLKSKKLKL | PPGPLAVPVF | 46 |

| | | | | | | |
|---|---|---|---|---|---|---|
| SEQ-ID-NO-289-CLONE-41046 | GNWLQVGDDL | NHRNLVDYAK | KFGDLFLLRM | GQRNLVVVSS | PDLTKEVLLT | 93 |
| SEQ-ID-NO-816-GI-54634694 | GNWLQVGDDL | NHRNLTDLAK | KYGKIFLLKM | GQRNLVVVSS | PDLAKEVLHT | 100 |
| SEQ-ID-NO-820-GI-38322956 | GNWLQVGDDL | NHRNLGDLAK | KYGEIFLLKM | GQRNLVVVSS | PELAKEVLHT | 96 |

| | | | | | | |
|---|---|---|---|---|---|---|
| SEQ-ID-NO-289-CLONE-41046 | QGVEFGSRTR | NVVFDIFTGK | GQDMVFTVYG | EHW------- | --------- | 126 |
| SEQ-ID-NO-816-GI-54634694 | QGVEFGSRTR | NVVFDIFTGK | GQDMVFTVYG | DHWRKMRRIM | TVPF----- | 144 |
| SEQ-ID-NO-820-GI-38322956 | QGVEFGSRTR | NVVFDIFTGK | GQDMVFTVYG | EHWRKMRRIM | TVPFFTNKVV | 146 |

| | | | |
|---|---|---|---|
| SEQ-ID-NO-289-CLONE-41046 | ---------- | ---------- | 126 |
| SEQ-ID-NO-816-GI-54634694 | ---------- | ---------- | 144 |
| SEQ-ID-NO-820-GI-38322956 | QQYRFAWEDE | LGRAVDDIKK | RPEASTTG | 174 |

Figure 22A

MODULATING LIGNIN IN PLANTS

CROSS-REFERENCE TO RELATED APPLICATION

This application is a National Stage application under 35 U.S.C. §371 and claims the benefit under 35 U.S.C. §119(a) of International Application No. PCT/US2007/022737, having an International Filing Date of Oct. 26, 2007, which claims the benefit of priority of the U.S. Provisional Application Ser. No. 60/855,108, having a filing date of Oct. 27, 2006, all of which are incorporated herein in their entirety.

STATEMENT AS TO FEDERALLY SPONSORED RESEARCH

Funding for the work described herein was provided by the federal government (U.S. Department of Energy Grant No. DE-FG02-05ER64111), which has certain rights in the invention.

INCORPORATION-BY-REFERENCE OF SEQUENCE LISTING

The material on the accompanying diskette is hereby incorporated by reference into this application. The accompanying compact discs contain one file, 11696-232WO1—Sequence.txt, which was created on Oct. 25, 2007. The file named 11696-232WO1—Sequence.txt is 3,471 KB. The file can be accessed using Microsoft Word on a computer that uses Windows OS.

TECHNICAL FIELD

This document relates to methods and materials involved in modulating (e.g., increasing or decreasing) lignin content in plants. For example, this document provides plants having a decreased amount of lignin as well as materials and methods for making plants having a decreased amount of lignin.

BACKGROUND

Phenylpropanoids are plant-derived organic compounds that are biosynthesized from the amino acid phenylalanine. Intermediates and end products of this pathway include compounds having important roles in plants, such as phytoalexins, antiherbivory compounds, antioxidants, ultra-violet protectants, pigments, and aroma compounds. The majority of the carbon in the pathway, however, is channeled toward the synthesis of lignin. As the second most abundant polymer on earth, exceeded only by cellulose, lignin is a major carbon sink in the biosphere, accounting for about 30% of the carbon sequestered into terrestrial plant material each year (Battle et al., *Science*, 287:2467 (2000)).

Lignin is a major structural component of secondarily thickened cell walls of tissues with conducting and/or mechanical functions. Angiosperm lignin is composed of three main units named p-hydroxyphenyl (H), guaiacyl (G), and syringyl (S) units. These components originate from the polymerization of three monolignols, p-coumaryl, coniferyl, and sinapyl alcohols, respectively. The monolignols are synthesized from phenylalanine through successive deamination, reduction, hydroxylation, and methylation steps. The proportions of H, G, and S units in the cell wall vary according to plant species and tissue type.

As a major polymer of cell walls, lignin has a direct impact on the characteristics of plants and plant products, such as wood. Highly lignified wood is durable and therefore a good raw material for many applications. Since lignin yields more energy when burned than cellulose, lignified wood is also an excellent fuel. The mechanical support provided by lignin prevents lodging, a problem in many agronomically important plants. On the other hand, lignin is detrimental to paper manufacture and must be removed from pulp before paper can be manufactured. This is costly both in terms of energy and the environment.

Lignin also makes it difficult to break down biomass for conversion into cellulosic ethanol biofuel. Cellulosic ethanol, which exhibits a net energy content three times higher than corn ethanol, can be produced from a wide variety of cellulosic biomass feedstocks including agricultural plant wastes, plant wastes from industrial processes and energy crops grown specifically for fuel production. Cellulosic biomass is composed largely of cellulose, hemicellulose and lignin, with smaller amounts of proteins, lipids and ash. Processing cellulosic biomass aims to extract fermentable sugars from the feedstock, which requires disruption of the hemicellulose/lignin sheath that surrounds the cellulose in plant material. Technological developments that increase the yield and drive down the production cost of cellulosic ethanol can help to reduce our oil dependency in a sustainable way. Given the role of lignin in the recalcitrance of biomass for conversion to biobased fuels, in addition to the many other roles of lignin, it is desirable to have the ability to produce plants with modulated levels of lignin.

SUMMARY

This document provides methods and materials related to plants having a modulated (e.g., increased or decreased) lignin content. For example, this document provides transgenic plants such as trees having increased amounts of lignin in thickened secondary cell walls for carbon sequestration, and biomass energy crops having decreased lignin for improved conversion efficiency to ethanol. Nucleic acids used to generate transgenic plants and plant cells having a modulated lignin content, and methods for making plants and plant cells having a modulated lignin content are also provided. Transgenic plants described herein can have modulated, e.g., increased or decreased, amounts and/or rates of biosynthesis of lignin. In addition, the structure and/or composition of lignin produced by such plants can vary from that produced by corresponding wild-type plants.

Reducing the lignin content in dedicated energy crops such as switchgrass can improve the yield and facilitate the production of ethanol from cellulosic feedstock. Reducing lignin in forage crops such as alfalfa can improve the quality and digestibility of such crops. In trees, a reduction in lignin content can improve paper pulp production. Increasing the lignin content in plants can also be useful. For example, increasing lignin in plants can enhance long-term carbon sequestration in plant biomass, which, in turn, may reduce atmospheric carbon dioxide and global warming. An increased lignin content can also prevent plant lodging, make vegetables more firm and crunchy, enhance the fiber content of foodstuffs, confer plants with improved pathogen resistance, and increase the amount of energy that can be obtained by burning wood.

In one aspect, a plant cell is provided. The plant cell comprises an exogenous nucleic acid comprising a regulatory region operably linked to a polynucleotide encoding a lignin-modulating polypeptide comprising an amino acid sequence having 80% or greater sequence identity to an amino acid sequence selected from the group consisting of SEQ ID NO:96, SEQ ID NOs:98-107, SEQ ID NOs:109-111, SEQ ID NOs:113-114, SEQ ID NOs:116-124, SEQ ID NOs:126-127, SEQ ID NOs:129-130, SEQ ID NO:132, SEQ ID NO:134, SEQ ID NO:136, SEQ ID NO:138, SEQ ID NO:140, SEQ ID NOs:142-143, SEQ ED NOs:145-147, SEQ ID NOs:149-150, SEQ ID NOs:152-156, SEQ ID NO:158, SEQ ID NOs:160-163, SEQ ID NO:165, SEQ ID NOs:167-174, SEQ ID NOs:176-181, SEQ ID NO:183, SEQ ID NO:185, SEQ ID NOs:187-188, SEQ ID NO:190, SEQ ID NOs:192-194, SEQ ID NOs:196-197, SEQ ID NO:199, SEQ ID NOs:201-202, SEQ ID NO:204, SEQ ID NO:206, SEQ ID NO:208, SEQ ID NOs:210-214, SEQ ID NO:216, SEQ ID NOs:218-220, SEQ ID NO:222, SEQ ID NO:224, SEQ ID NOs:226-227, SEQ ID NO:229, SEQ ID NO:231, SEQ ID NOs:233-238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NOs:256-268, SEQ ID NOs:270-279, SEQ ID NOs:281-282, SEQ ID NO:284, SEQ ID NOs:286-287, SEQ ID NO:289, SEQ ID NOs:291-298, SEQ ID NO:300, SEQ ID NO:302, SEQ ID NOs:304-309, SEQ ID NOs:311-319, SEQ ID NOs:321-330, SEQ ID NOs:332-340, SEQ ID NO:342, SEQ ID NO:344, SEQ ID NOs:355-356, SEQ ID NOs:358-369, SEQ ID NO:371, SEQ ID NOs:373-385, SEQ ID NOs:387-388, SEQ ID NOs:390-395, SEQ ID NO:397, SEQ ID NO:399, SEQ ID NOs:401-407, SEQ ID NOs:409-463, SEQ ID NOs:465-496, SEQ ID NOs:498-500, SEQ ID NOs:502-503, SEQ ID NO:505, SEQ ID NOs:507-511, SEQ ID NOs:513-540, SEQ ID NO:542, SEQ ID NOs:544-577, SEQ ID NOs:579-581, SEQ ID NO:583, SEQ ID NO:585-587, SEQ ID NOs:589-590, SEQ ID NO:592, SEQ ID NOs:594-599, SEQ ID NOs:601-617, SEQ ID NO:619, SEQ ID NOs:621-638, SEQ ID NOs:640-672, SEQ ID NO:674, SEQ ID NOs:676-678, SEQ ID NO:680, SEQ ID NOs:682-685, SEQ ID NO:687, SEQ ID NO:689, SEQ ID NOs:691-714, SEQ ID NOs:716-717, SEQ ID NOs:719-737, SEQ ID NO:739, SEQ ID NOs:741-766, SEQ ID NO:768, SEQ ID NOs:770-776, SEQ ID NO:778, SEQ ID NOs:780-786, SEQ ID NOs:788-792, SEQ ID NO:794-807, and SEQ ID NOs:809-820; where a tissue of a plant produced from the plant cell has a difference in lignin content as compared to the corresponding lignin content in tissue of a control plant that does not comprise the nucleic acid.

The sequence identity can be 85% or greater, 90% or greater, or 95% or greater. The difference can be an increased lignin content. The difference can be a difference in the chemical composition of lignin. The difference can be a decreased lignin content. The plant cell can be capable of producing one or more lignin monomers. The plant can be from a genus selected from the group consisting of *Agrostis, Avena, Festuca, Hordeum, Lolium, Medicago, Milium, Miscanthus, Panicum, Poa, Saccharum, Sorghum, Trifolium, Triticum,* and *Zea*. The plant can be a species selected from *Miscanthus* hybrid (*Miscanthus×giganteus*), *Miscanthus sinensis, Miscanthus sacchariflorus, Panicum virgatum, Populus balsamifera,* and *Saccharum* spp.

The polypeptide sequence can be selected from the group consisting of a polypeptide having 80% or greater sequence identity to SEQ ID NOs:98-107, SEQ ID NOs:109-111, SEQ ID NOs:113-114, SEQ ID NOs:116-124, SEQ ID NOs:160-163, SEQ ID NO:165, SEQ ID NOs:167-174, SEQ ID NOs:218-220, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NOs:256-268, SEQ ID NOs:270-279, SEQ ID NOs:281-282, SEQ ID NO:344, SEQ ID NOs:378-379, SEQ ID NOs:382-383, SEQ ID NO:388, SEQ ID NOs:390-391, SEQ ID NO:393, SEQ ID NO:397, SEQ ID NO:402, SEQ ID NO:407, SEQ ID NOs:409-414, SEQ ID NO:416, SEQ ID NOs:418-420, SEQ ID NOs:423-424, SEQ ID NO:426, SEQ ID NO:430, SEQ ID NO:436, SEQ ID NO:443, SEQ ID NOs:447-452, SEQ ID NO:454, SEQ ID NO:456, SEQ ID NO:458, SEQ ID NOs:461-462, SEQ ID NOs:465-466, SEQ ID NOs:468-469, SEQ ID NOs:471-472, SEQ ID NOs:474-475, SEQ ID NOs:477-478, SEQ ID NOs:484-486, SEQ ID NO:488, SEQ ID NOs:770-776, SEQ ID NO:778, SEQ ID NOs:780-781, and SEQ ID NO:783.

The polynucleotide can be transcribed into an interfering RNA effective for inhibiting expression of a polypeptide selected from the group consisting of a polypeptide having 80% or greater sequence identity to SEQ ID NO:96, SEQ ID NOs:126-127, SEQ ID NOs:129-130, SEQ ID NO:132, SEQ ID NO:134, SEQ ID NO:136, SEQ ID NO:138, SEQ ID NO:140, SEQ ID NOs:142-143, SEQ ID NOs:145-147, SEQ ID NOs:149-150, SEQ ID NOs:152-156, SEQ ID NO:158, SEQ ID NOs:176-181, SEQ ID NO:183, SEQ ID NO:185, SEQ ID NOs:187-188, SEQ ID NO:190, SEQ ID NOs:192-194, SEQ ID NOs:196-197, SEQ ID NO:199, SEQ ID NOs:201-202, SEQ ID NO:204, SEQ ID NO:206, SEQ ID NO:208, SEQ ID NOs:210-214, SEQ ID NO:216, SEQ ID NO:222, SEQ ID NO:224, SEQ ID NOs:226-227, SEQ ID NO:229, SEQ ID NO:231, SEQ ID NOs:233-238, SEQ ID NO:284, SEQ ID NOs:286-287, SEQ ID NO:289, SEQ ID NOs:291-298, SEQ ID NO:300, SEQ ID NO:302, SEQ ID NO:304-309, SEQ ID NO:311-319, SEQ ID NO:321-330, SEQ ID NO:332-340, SEQ ID NO:342, SEQ ID NOs:355-356, SEQ ID NOs:358-369, SEQ ID NO:371, SEQ ID NOs:373-377, SEQ ID NO:492-496, SEQ ID NOs:498-500, SEQ ID NOs:502-503, SEQ ID NO:505, SEQ ID NOs:507-511, SEQ ID NOs:513-540, SEQ ID NO:542, SEQ ID NOs:544-577, SEQ ID NOs:579-581, SEQ ID NO:583, SEQ ID NO:585-587, SEQ ID NOs:589-590, SEQ ID NO:592, SEQ ID NOs:594-599, SEQ ID NOs:601-617, SEQ ID NO:619, SEQ ID NOs:621-638, SEQ ID NOs:640-672, SEQ ID NO:674, SEQ ID NOs:676-678, SEQ ID NO:680, SEQ ID NOs:682-685, SEQ ID NO:687, SEQ ID NO:689, SEQ ID NOs:691-714, SEQ ID NOs:716-717, SEQ ID NOs:719-737, SEQ ID NO:739, SEQ ID NOs:741-766, SEQ ID NOs:788-792, SEQ ID NO:794-807, and SEQ ID NOs:809-820.

The regulatory region can be a promoter. The promoter can be a lignin or cellulose biosynthesis promoter. The promoter can be selected from the group consisting of SEQ ID NOs:345-354. The promoter can be a tissue-preferential promoter. The tissue can be secondary cell wall, vascular, stem, pith, xylem, phloem, root, tuber, or leaf tissue. The promoter can be a cell type-preferential promoter. The cell can be a sieve, laticifer, companion, sclerenchyma, or xylem cell. The promoter can be an inducible promoter. The plant cell can be capable of producing one or more lignin monomers.

The plant can be from a genus selected from the group consisting of *Eucalyptus, Hordeum, Medicago, Miscanthus, Oryza, Panicum, Pinus, Populus, Prunus, Quercus, Saccharum, Sorghum, Trifolium, Triticum,* and *Zea*. The plant can be a species selected from *Miscanthus* hybrid (*Miscanthus×giganteus*), *Miscanthus sinensis, Miscanthus sacchariflorus, Panicum virgatum, Populus balsamifera,* and *Saccharum* spp.

The cell can further comprise a nucleic acid encoding a second lignin-modulating polypeptide operably linked to a second regulatory region. The nucleic acid encoding a second lignin-modulating polypeptide operably linked to a second regulatory region can be present on a second recombinant nucleic acid construct.

In another aspect, a plant is provided. The plant comprises any of the plant cells described above. Progeny of the plant also are provided, where the progeny have a difference in lignin content as compared to the corresponding lignin content in tissue of a control plant that does not comprise the nucleic acid.

In another aspect, a plant cell is provided. The plant cell comprises an exogenous nucleic acid, the exogenous nucleic acid comprising a regulatory region operably linked to a polynucleotide whose transcription product is at least 30 nucleotides in length and is complementary to a nucleic acid encoding a lignin-modulating polypeptide, the lignin-modulating polypeptide selected from the group consisting of a polypeptide having 80% or greater sequence identity to SEQ ID NO:96, SEQ ID NOs:98-107, SEQ ID NOs:109-111, SEQ ID NOs:113-114, SEQ ID NOs:116-124, SEQ ID NOs:126-127, SEQ ID NOs:129-130, SEQ ID NO:132, SEQ ID NO:134, SEQ ID NO:136, SEQ ID NO:138, SEQ ID NO:140, SEQ ID NOs:142-143, SEQ ID NOs:145-147, SEQ ID NOs:149-150, SEQ ID NOs:152-156, SEQ ID NO:158, SEQ ID NOs:160-163, SEQ ID NO:165, SEQ ID NOs:167-174, SEQ ID NOs:176-181, SEQ ID NO:183, SEQ ID NO:185, SEQ ID NOs:187-188, SEQ ID NO:190, SEQ ID NOs:192-194, SEQ ID NOs:196-197, SEQ ID NO:199, SEQ ID NOs:201-202, SEQ ID NO:204, SEQ ID NO:206, SEQ ID NO:208, SEQ ID NOs:210-214, SEQ ID NO:216, SEQ ID NOs:218-220, SEQ ID NO:222, SEQ ID NO:224, SEQ ID NOs:226-227, SEQ ID NO:229, SEQ ID NO:231, SEQ ID NOs:233-238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NOs:256-268, SEQ ID NOs:270-279, SEQ ID NOs:281-282, SEQ ID NO:284, SEQ ID NOs:286-287, SEQ ID NO:289, SEQ ID NOs:291-298, SEQ ID NO:300, SEQ ID NO:302, SEQ ID NOs:304-309, SEQ ID NOs:311-319, SEQ ID NOs:321-330, SEQ ID NOs:332-340, SEQ ID NO:342, SEQ ID NO:344, SEQ ID NOs:355-356, SEQ ID NOs:358-369, SEQ ID NO:371, SEQ ID NOs:373-385, SEQ ID NOs:387-388, SEQ ID NOs:390-395, SEQ ID NO:397, SEQ ID NO:399, SEQ ID NOs:401-407, SEQ ID NOs:409-463, SEQ ID NOs:465-496, SEQ ID NOs:498-500, SEQ ID NOs:502-503, SEQ ID NO:505, SEQ ID NOs:507-511, SEQ ID NOs:513-540, SEQ ID NO:542, SEQ ID NOs:544-577, SEQ ID NOs:579-581, SEQ ID NO:583, SEQ ID NOs:585-587, SEQ ID NOs:589-590, SEQ ID NO:592, SEQ ID NOs:594-599, SEQ ID NOs:601-617, SEQ ID NO:619, SEQ ID NOs:621-638, SEQ ID NOs:640-672, SEQ ID NO:674, SEQ ID NOs:676-678, SEQ ID NO:680, SEQ ID NOs:682-685, SEQ ID NO:687, SEQ ID NO:689, SEQ ID NOs:691-714, SEQ ID NOs:716-717, SEQ ID NOs:719-737, SEQ ID NO:739, SEQ ID NOs:741-766, SEQ ID NO:768, SEQ ID NOs:770-776, SEQ ID NO:778, SEQ ID NOs:780-786, SEQ ID NOs:788-792, SEQ ID NO:794-807, and SEQ ID NOs:809-820; where a tissue of a plant produced from the plant cell has a difference in lignin content as compared to the corresponding lignin content in tissue of a control plant that does not comprise the nucleic acid. The exogenous nucleic acid can further comprise a 3' UTR operably linked to the polynucleotide. The polynucleotide can be transcribed into an interfering RNA comprising a stem-loop structure. The stem-loop structure can comprise an inverted repeat of the 3' UTR.

In another aspect, a plant cell is provided. The plant cell comprises an exogenous nucleic acid, the exogenous nucleic acid comprising a regulatory region operably linked to a polynucleotide that is transcribed into an interfering RNA effective for inhibiting expression of a lignin-modulating polypeptide selected from the group consisting of a polypeptide having 80% or greater sequence identity to SEQ ID NO:96, SEQ ID NOs:98-107, SEQ ID NOs:109-111, SEQ ID NOs:113-114, SEQ ID NOs:116-124, SEQ ID NOs:126-127, SEQ ID NOs:129-130, SEQ ID NO:132, SEQ ID NO:134, SEQ ID NO:136, SEQ ID NO:138, SEQ ID NO:140, SEQ ID NOs:142-143, SEQ ID NOs:145-147, SEQ ID NOs:149-150, SEQ ID NOs:152-156, SEQ ID NO:158, SEQ ID NOs:160-163, SEQ ID NO:165, SEQ ID NOs:167-174, SEQ ID NOs:176-181, SEQ ID NO:183, SEQ ID NO:185, SEQ ID NOs:187-188, SEQ ID NO:190, SEQ ID NOs:192-194, SEQ ID NOs:196-197, SEQ ID NO:199, SEQ ID NOs:201-202, SEQ ID NO:204, SEQ ID NO:206, SEQ ID NO:208, SEQ ID NOs:210-214, SEQ ID NO:216, SEQ ID NOs:218-220, SEQ ID NO:222, SEQ ID NO:224, SEQ ID NOs:226-227, SEQ ID NO:229, SEQ ID NO:231, SEQ ID NOs:233-238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NOs:256-268, SEQ ID NOs:270-279, SEQ ID NOs:281-282, SEQ ID NO:284, SEQ ID NOs:286-287, SEQ ID NO:289, SEQ ID NOs:291-298, SEQ ID NO:300, SEQ ID NO:302, SEQ ID NOs:304-309, SEQ ID NOs:311-319, SEQ ID NOs:321-330, SEQ ID NOs:332-340, SEQ ID NO:342, SEQ ID NO:344, SEQ ID NOs:355-356, SEQ ID NOs:358-369, SEQ ID NO:371, SEQ ID NOs:373-385, SEQ ID NOs:387-388, SEQ ID NOs:390-395, SEQ ID NO:397, SEQ ID NO:399, SEQ ID NOs:401-407, SEQ ID NOs:409-463, SEQ ID NOs:465-496, SEQ ID NOs:498-500, SEQ ID NOs:502-503, SEQ ID NO:505, SEQ ID NOs:507-511, SEQ ID NOs:513-540, SEQ ID NO:542, SEQ ID NOs:544-577, SEQ ID NOs:579-581, SEQ ID NO:583, SEQ ID NOs:585-587, SEQ ID NOs:589-590, SEQ ID NO:592, SEQ ID NOs:594-599, SEQ ID NOs:601-617, SEQ ID NO:619, SEQ ID NOs:621-638, SEQ ID NOs:640-672, SEQ ID NO:674, SEQ ID NOs:676-678, SEQ ID NO:680, SEQ ID NOs:682-685, SEQ ID NO:687, SEQ ID NO:689, SEQ ID NOs:691-714, SEQ ID NOs:716-717, SEQ ID NOs:719-737, SEQ ID NO:739, SEQ ID NOs:741-766, SEQ ID NO:768, SEQ ID NOs:770-776, SEQ ID NO:778, SEQ ID NOs:780-786, SEQ ID NOs:788-792, SEQ ID NO:794-807, and SEQ ID NOs:809-820; where a tissue of a plant produced from the plant cell has a difference in lignin content as compared to the corresponding lignin content in tissue of a control plant that does not comprise the nucleic acid.

The sequence identity can be 85% or greater, 90% or greater, or 95% or greater. The difference can be an increased lignin content. The plant cell can be capable of producing one or more lignin monomers. The plant can be from a genus selected from the group consisting of *Acer, Afzelia, Eucalyptus, Fraxinus, Juglans, Pinus, Populus, Prunus, Quercus*, and *Solanum*. The plant can be a species selected from *Populus balsamifera* and *Solanum lycopersicum*. The difference can be a difference in the chemical composition of lignin. The difference can be a decreased lignin content. The regulatory region can be a promoter. The promoter can be a lignin or cellulose biosynthesis promoter. The promoter can be selected from the group consisting of SEQ ID NOs:345-354. The promoter can be a tissue-preferential promoter. The tissue can be secondary cell wall, vascular, stem, pith, xylem, phloem, root, tuber, or leaf tissue. The promoter can be a cell type-preferential promoter. The cell can be a sieve, laticifer, companion, sclerenchyma, or xylem cell. The promoter can be an inducible promoter. The cell can further comprise a nucleic acid encoding a second lignin-modulating polypeptide operably linked to a second regulatory region. The nucleic acid encoding a second lignin-modulating polypeptide operably linked to a second regulatory region can be present on a second recombinant nucleic acid construct.

In another aspect, a method of modulating the lignin content in a plant is provided. The method comprises introducing into a plant cell an exogenous nucleic acid comprising a regulatory region operably linked to a polynucleotide whose transcription product is at least 30 nucleotides in length and is complementary to a nucleic acid encoding a lignin-modulating polypeptide, the lignin-modulating polypeptide selected from the group consisting of a polypeptide having 80% or greater sequence identity to SEQ ID NO:96, SEQ ID NOs:98-107, SEQ ID NOs:109-111, SEQ ID NOs:113-114, SEQ ID NOs:116-124, SEQ ID NOs:126-127, SEQ ID NOs:129-130, SEQ ID NO:132, SEQ ID NO:134, SEQ ID NO:136, SEQ ID NO:138, SEQ ID NO:140, SEQ ID NOs:142-143, SEQ ID NOs:145-147, SEQ ID NOs:149-150, SEQ ID NOs:152-156, SEQ ID NO:158, SEQ ID NOs:160-163, SEQ ID NO:165, SEQ ID NOs:167-174, SEQ ID NOs:176-181, SEQ ID NO:183, SEQ ID NO:185, SEQ ID NOs:187-188, SEQ ID NO:190, SEQ ID NOs:192-194, SEQ ID NOs:196-197, SEQ ID NO:199, SEQ ID NOs:201-202, SEQ ID NO:204, SEQ ID NO:206, SEQ ID NO:208, SEQ ID NOs:210-214, SEQ ID NO:216, SEQ ID NOs:218-220, SEQ ID NO:222, SEQ ID NO:224, SEQ ID NOs:226-227, SEQ ID NO:229, SEQ ID NO:231, SEQ ID NOs:233-238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NOs:256-268, SEQ ID NOs:270-279, SEQ ID NOs:281-282, SEQ ID NO:284, SEQ ID NOs:286-287, SEQ ID NO:289, SEQ ID NOs:291-298, SEQ ID NO:300, SEQ ID NO:302, SEQ ID NOs:304-309, SEQ ID NOs:311-319, SEQ ID NOs:321-330, SEQ ID NOs:332-340, SEQ ID NO:342, SEQ ID NO:344, SEQ ID NOs:355-356, SEQ ID NOs:358-369, SEQ ID NO:371, SEQ ID NOs:373-385, SEQ ID NOs:387-388, SEQ ID NOs:390-395, SEQ ID NO:397, SEQ ID NO:399, SEQ ID NOs:401-407, SEQ ID NOs:409-463, SEQ ID NOs:465-496, SEQ ID NOs:498-500, SEQ ID NOs:502-503, SEQ ID NO:505, SEQ ID NOs:507-511, SEQ ID NOs:513-540, SEQ ID NO:542, SEQ ID NOs:544-577, SEQ ID NOs:579-581, SEQ ID NO:583, SEQ ID NOs:585-587, SEQ ID NOs:589-590, SEQ ID NO:592, SEQ ID NOs:594-599, SEQ ID NOs:601-617, SEQ ID NO:619, SEQ ID NOs:621-638, SEQ ID NOs:640-672, SEQ ID NO:674, SEQ ID NOs:676-678, SEQ ID NO:680, SEQ ID NOs:682-685, SEQ ID NO:687, SEQ ID NO:689, SEQ ID NOs:691-714, SEQ ID NOs:716-717, SEQ ID NOs:719-737, SEQ ID NO:739, SEQ ID NOs:741-766, SEQ ID NO:768, SEQ ID NOs:770-776, SEQ ID NO:778, SEQ ID NOs:780-786, SEQ ID NOs:788-792, SEQ ID NO:794-807, and SEQ ID NOs:809-820; where a tissue of a plant produced from the plant cell has a difference in lignin content as compared to the corresponding lignin content in tissue of a control plant that does not comprise the nucleic acid.

In another aspect, a method of modulating the lignin content in a plant is provided. The method comprises introducing into a plant cell an exogenous nucleic acid comprising a regulatory region operably linked to a polynucleotide that is transcribed into an interfering RNA effective for inhibiting expression of a lignin-modulating polypeptide selected from the group consisting of a polypeptide having 80% or greater sequence identity to SEQ ID NO:96, SEQ ID NOs:98-107, SEQ ID NOs:109-111, SEQ ID NOs:113-114, SEQ ID NOs:116-124, SEQ ID NOs:126-127, SEQ ID NOs:129-130, SEQ ID NO:132, SEQ ID NO:134, SEQ ID NO:136, SEQ ID NO:138, SEQ ID NO:140, SEQ ID NOs:142-143, SEQ ID NOs:145-147, SEQ ID NOs:149-150, SEQ ID NOs:152-156, SEQ ID NO:158, SEQ ID NOs:160-163, SEQ ID NO:165, SEQ ID NOs:167-174, SEQ ID NOs:176-181, SEQ ID NO:183, SEQ ID NO:185, SEQ ID NOs:187-188, SEQ ID NO:190, SEQ ID NOs:192-194, SEQ ID NOs:196-197, SEQ ID NO:199, SEQ ID NOs:201-202, SEQ ID NO:204, SEQ ID NO:206, SEQ ID NO:208, SEQ ID NOs:210-214, SEQ ID NO:216, SEQ ID NOs:218-220, SEQ ID NO:222, SEQ ID NO:224, SEQ ID NOs:226-227, SEQ ID NO:229, SEQ ID NO:231, SEQ ID NOs:233-238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NOs:256-268, SEQ ID NOs:270-279, SEQ ID NOs:281-282, SEQ ID NO:284, SEQ ID NOs:286-287, SEQ ID NO:289, SEQ ID NOs:291-298, SEQ ID NO:300, SEQ ID NO:302, SEQ ID NOs:304-309, SEQ ID NOs:311-319, SEQ ID NOs:321-330, SEQ ID NOs:332-340, SEQ ID NO:342, SEQ ID NO:344, SEQ ID NOs:355-356, SEQ ID NOs:358-369, SEQ ID NO:371, SEQ ID NOs:373-385, SEQ ID NOs:387-388, SEQ ID NOs:390-395, SEQ ID NO:397, SEQ ID NO:399, SEQ ID NOs:401-407, SEQ ID NOs:409-463, SEQ ID NOs:465-496, SEQ ID NOs:498-500, SEQ ID NOs:502-503, SEQ ID NO:505, SEQ ID NOs:507-511, SEQ ID NOs:513-540, SEQ ID NO:542, SEQ ID NOs:544-577, SEQ ID NOs:579-581, SEQ ID NO:583, SEQ ID NOs:585-587, SEQ ID NOs:589-590, SEQ ID NO:592, SEQ ID NOs:594-599, SEQ ID NOs:601-617, SEQ ID NO:619, SEQ ID NOs:621-638, SEQ ID NOs:640-672, SEQ ID NO:674, SEQ ID NOs:676-678, SEQ ID NO:680, SEQ ID NOs:682-685, SEQ ID NO:687, SEQ ID NO:689, SEQ ID NOs:691-714, SEQ ID NOs:716-717, SEQ ID NOs:719-737, SEQ ID NO:739, SEQ ID NOs:741-766, SEQ ID NO:768, SEQ ID NOs:770-776, SEQ ID NO:778, SEQ ID NOs:780-786, SEQ ID NOs:788-792, SEQ ID NO:794-807, and SEQ ID NOs:809-820; where a tissue of a plant produced from the plant cell has a difference in lignin content as compared to the corresponding lignin content in tissue of a control plant that does not comprise the nucleic acid.

The exogenous nucleic acid can further comprise a 3' UTR operably linked to the polynucleotide. The polynucleotide can be transcribed into an interfering RNA comprising a stem-loop structure. The stem-loop structure can comprise an inverted repeat of the 3' UTR. The difference can be a decreased lignin content. The plant can be from a genus selected from the group consisting of Agrostis, Avena, Festuca, Hordeum, Lolium, Medicago, Milium, Miscanthus, Panicum, Poa, Saccharum, Sorghum, Trifolium, Triticum, and Zea.

In another aspect, an isolated nucleic acid molecule is provided. The isolated nucleic acid molecule comprises a nucleotide sequence having 95% or greater sequence identity to the nucleotide sequence set forth in SEQ ID NO:108, SEQ ID NO:112, SEQ ID NO:115, SEQ ID NO:128, SEQ ID NO:131, SEQ ID NO:137, SEQ ID NO:139, SEQ ID NO:141, SEQ ID NO:144, SEQ ID NO:151, SEQ ID NO:157, SEQ ID NO:164, SEQ ID NO:166, SEQ ID NO:184, SEQ ID NO:186, SEQ ID NO:198, SEQ ID NO:200, SEQ ID NO:205, SEQ ID NO:207, SEQ ID NO:209, SEQ ID NO:223, SEQ ID NO:228, SEQ ID NO:230, SEQ ID NO:232, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:269, SEQ ID NO:299, SEQ ID NO:301, SEQ ID NO:303, SEQ ID NO:310, SEQ ID NO:320, SEQ ID NO:331, SEQ ID NO:341, SEQ ID NO:343, SEQ ID NO:357, SEQ ID NO:370, SEQ ID NO:386, SEQ ID NO:389, SEQ ID NO:396, SEQ ID NO:398, SEQ ID NO:400, SEQ ID NO:408, SEQ ID NO:464, SEQ ID NO:497, SEQ ID NO:501, SEQ ID NO:504, SEQ ID NO:506, SEQ ID NO:512, SEQ ID NO:541, SEQ ID NO:578, SEQ ID NO:582, SEQ ID NO:584, SEQ ID NO:591, SEQ ID NO:593, SEQ ID NO:600, SEQ ID NO:618, SEQ ID NO:639, SEQ ID NO:673, SEQ ID NO:675, SEQ ID NO:679, SEQ ID NO:681, SEQ ID NO:688, SEQ ID NO:690, SEQ ID NO:715, SEQ ID NO:738, SEQ ID NO:740, SEQ ID NO:767, SEQ ID NO:769, SEQ ID NO:779, SEQ ID NO:787, SEQ ID NO:793, or SEQ ID NO:808.

In another aspect, an isolated nucleic acid is provided. The isolated nucleic acid comprises a nucleotide sequence encoding a polypeptide having 80% or greater sequence identity to the amino acid sequence set forth in SEQ ID NO:109, SEQ ID NO:113, SEQ ID NO:116, SEQ ID NO:129, SEQ ID NO:132, SEQ ID NO:138, SEQ ID NO:140, SEQ ID NO:142, SEQ ID NO:145, SEQ ID NO:152, SEQ ID NO:158, SEQ ID NO:165, SEQ ID NO:167, SEQ ID NO:185, SEQ ID NO:187, SEQ ID NO:199, SEQ ID NO:201, SEQ ID NO:206, SEQ ID NO:208, SEQ ID NO:210, SEQ ID NO:224, SEQ ID NO:229, SEQ ID NO:231, SEQ ID NO:233, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:270, SEQ ID NO:300, SEQ ID NO:302, SEQ ID NO:304, SEQ ID NO:311, SEQ ID NO:321, SEQ ID NO:332, SEQ ID NO:342, SEQ ID NO:344, SEQ ID NO:358, SEQ ID NO:371, SEQ ID NO:389, SEQ ID NO:390, SEQ ID NO:397, SEQ ID NO:399, SEQ ID NO:401, SEQ ID NO:409, SEQ ID NO:465, SEQ ID NO:498, SEQ ID NO:502, SEQ ID NO:505, SEQ ID NO:507, SEQ ID NO:513, SEQ ID NO:542, SEQ ID NO:579, SEQ ID NO:583, SEQ ID NO:585, SEQ ID NO:592, SEQ ID NO:594, SEQ ID NO:601, SEQ ID NO:619, SEQ ID NO:640, SEQ ID NO:674, SEQ ID NO:676, SEQ ID NO:680, SEQ ID NO:682, SEQ ID NO:689, SEQ ID NO:691, SEQ ID NO:716, SEQ ID NO:739, SEQ ID NO:741, SEQ ID NO:768, SEQ ID NO:770, SEQ ID NO:780, SEQ ID NO:788, SEQ ID NO:794, or SEQ ID NO:809.

In yet another aspect, a method of producing a plant is provided. The method comprises growing a plant cell comprising an exogenous nucleic acid. The exogenous nucleic acid comprises a regulatory region operably linked to a nucleotide sequence encoding a polypeptide. The Hidden Markov Model (HMM) bit score of the amino acid sequence of the polypeptide is greater than about 20, using an HMM generated from the amino acid sequences depicted in one of FIGS. 1 to 22. The plant has a difference in lignin content as compared to the corresponding lignin content of a control plant that does not comprise said nucleic acid.

Methods of modulating the level of lignin in a plant are provided herein. In one aspect, a method comprises introducing into a plant cell an exogenous nucleic acid, said exogenous nucleic acid comprising a regulatory region operably linked to a nucleotide sequence encoding a polypeptide, wherein the HMM bit score of the amino acid sequence of said polypeptide is greater than about 20, said HMM based on the amino acid sequences depicted in one of FIGS. 1 to 22, and wherein a tissue of a plant produced from said plant cell has a difference in the lignin content as compared to the corresponding lignin content of a control plant that does not comprise said exogenous nucleic acid.

Plant cells comprising an exogenous nucleic acid are provided herein. The exogenous nucleic acid comprises a regulatory region operably linked to a nucleotide sequence encoding a polypeptide. The HMM bit score of the amino acid sequence of the polypeptide is greater than about 20, using an HMM generated from the amino acid sequences depicted in one of FIGS. 1 to 22. A tissue of a plant produced from the plant cell has a difference in lignin content as compared to the corresponding lignin content of a control plant that does not comprise the nucleic acid. A transgenic plant comprising such a plant cell also is provided.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

DESCRIPTION OF THE DRAWINGS

Figure 1A:
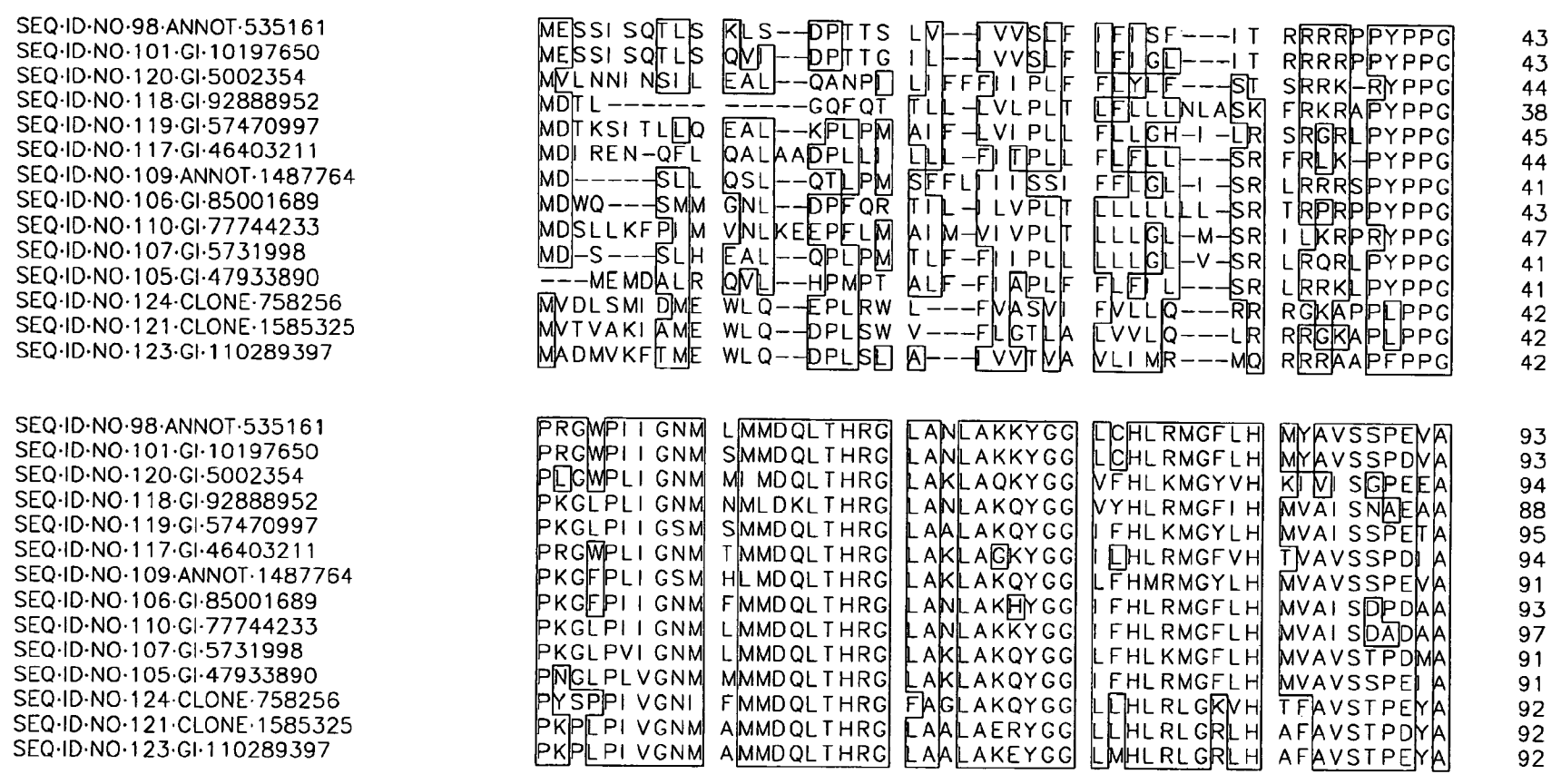
Figure 1B:
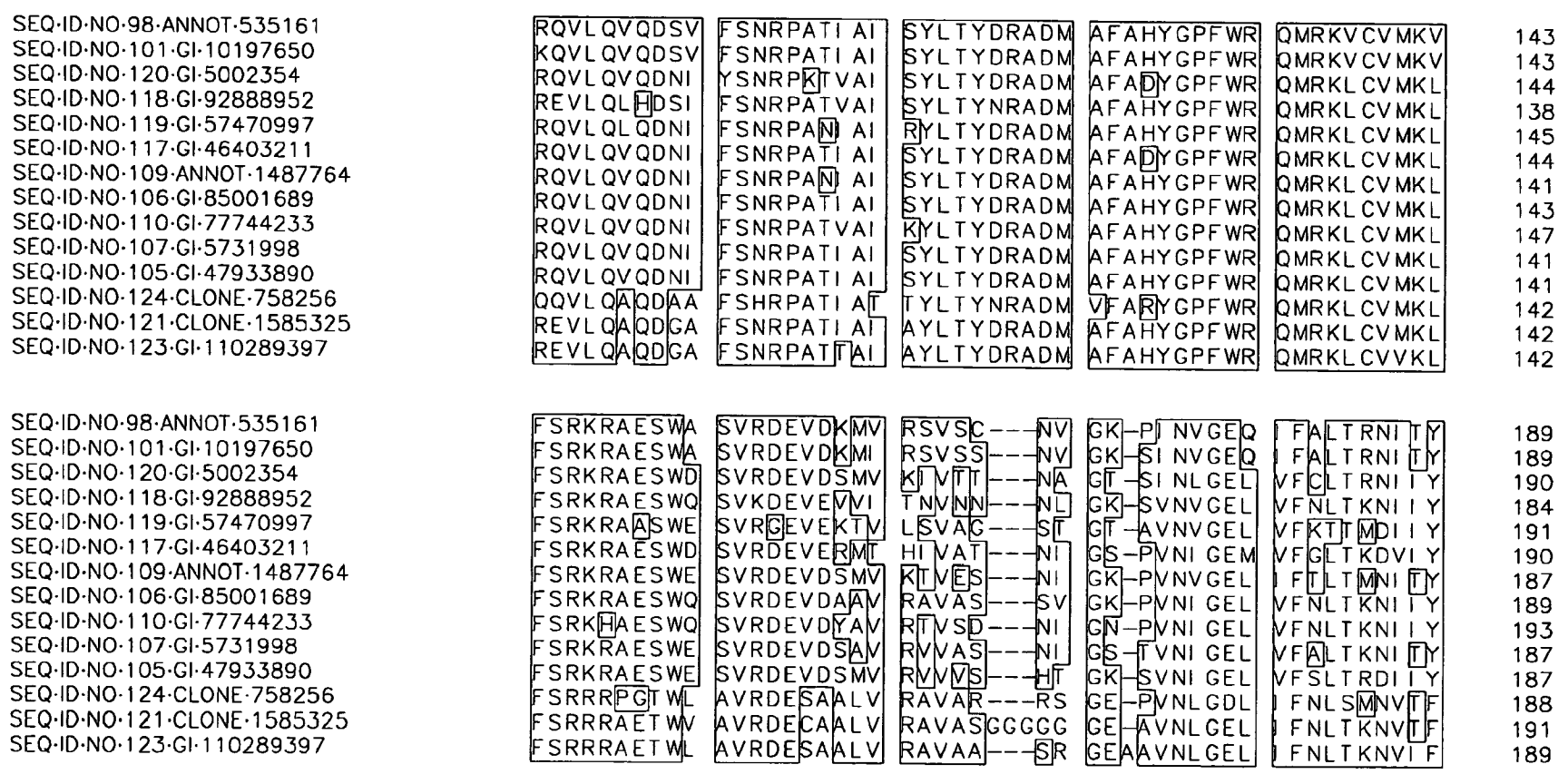
Figure 1C:
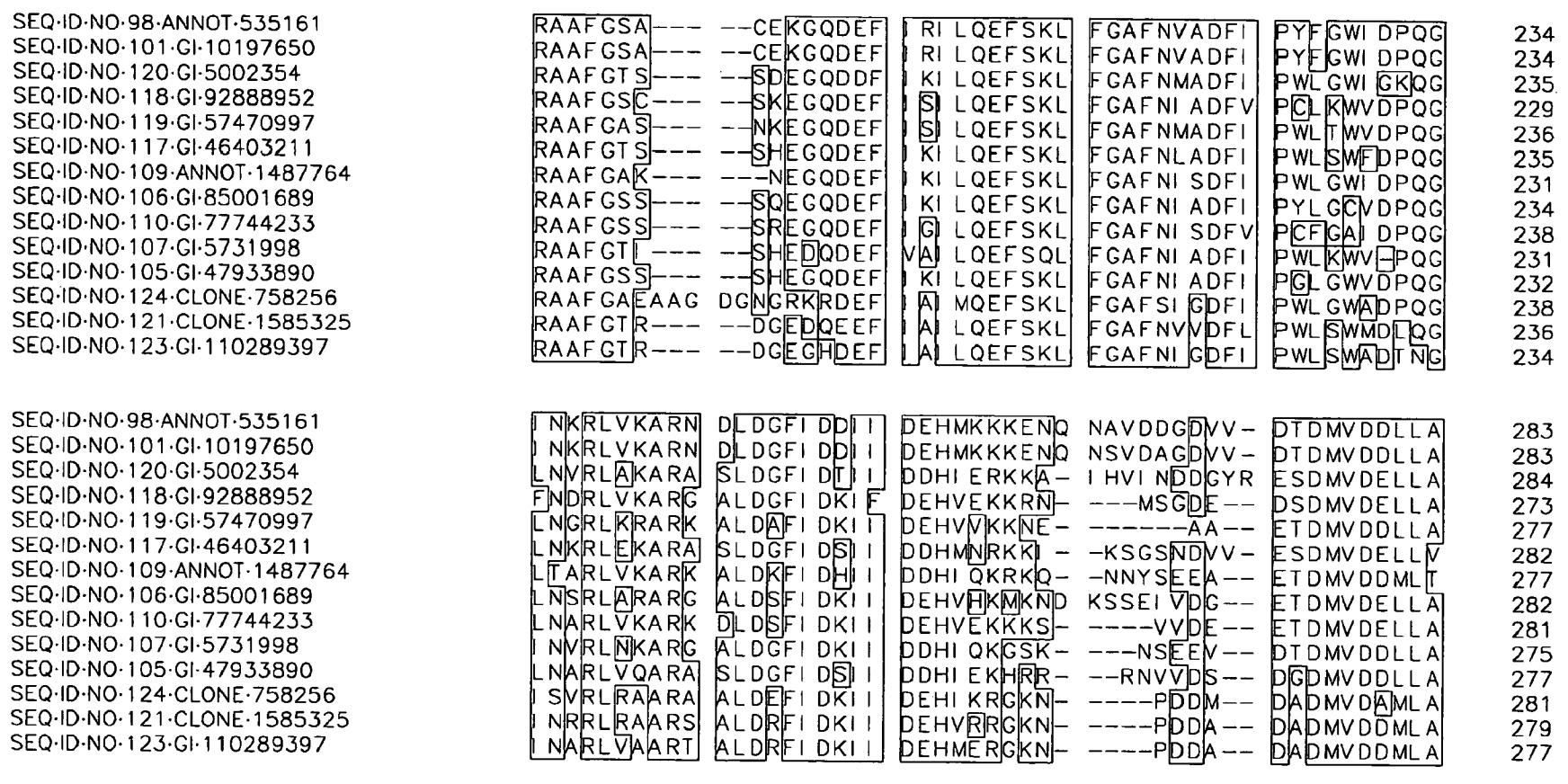
Figure 1D:
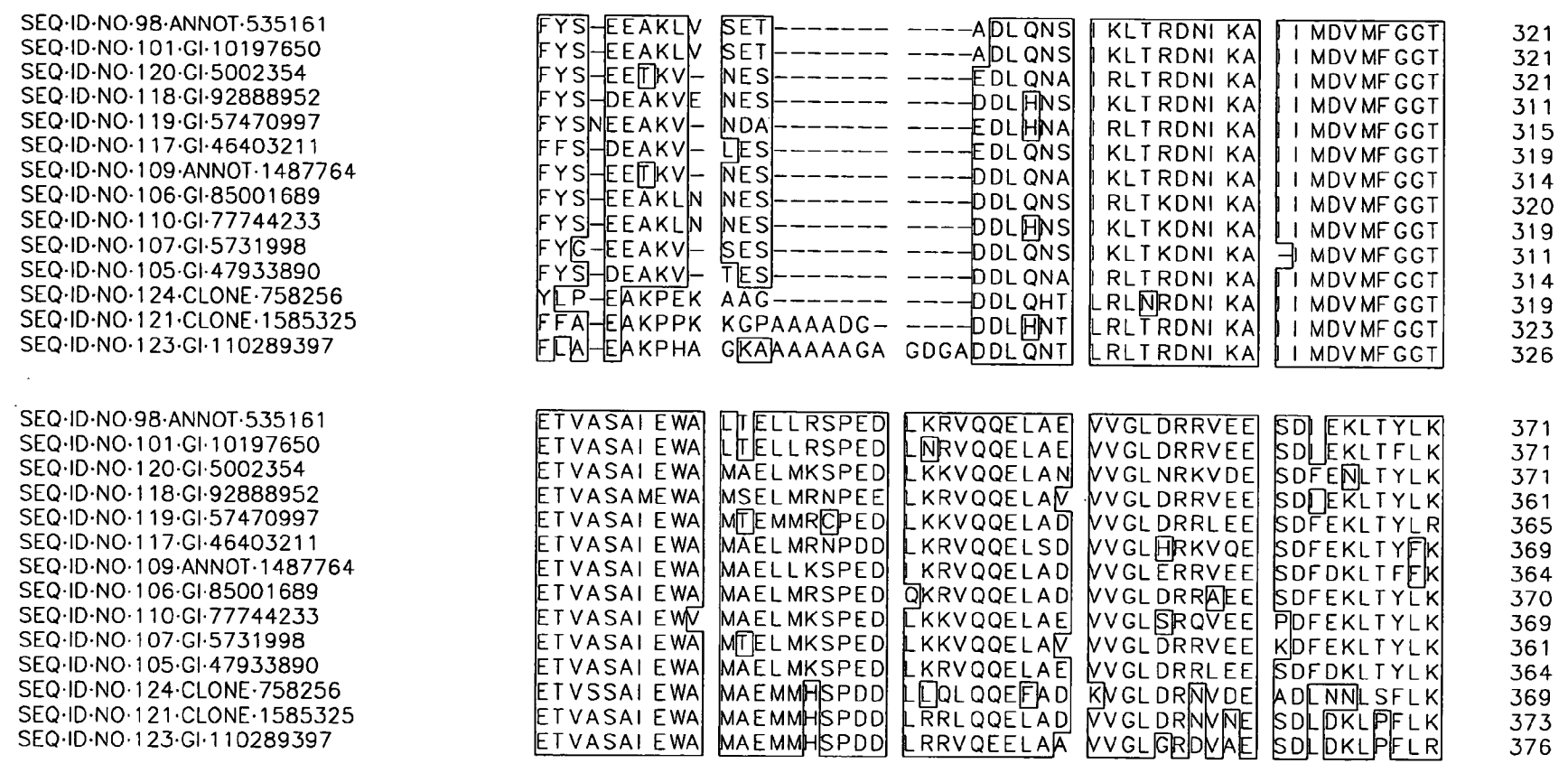
Figure 1E:
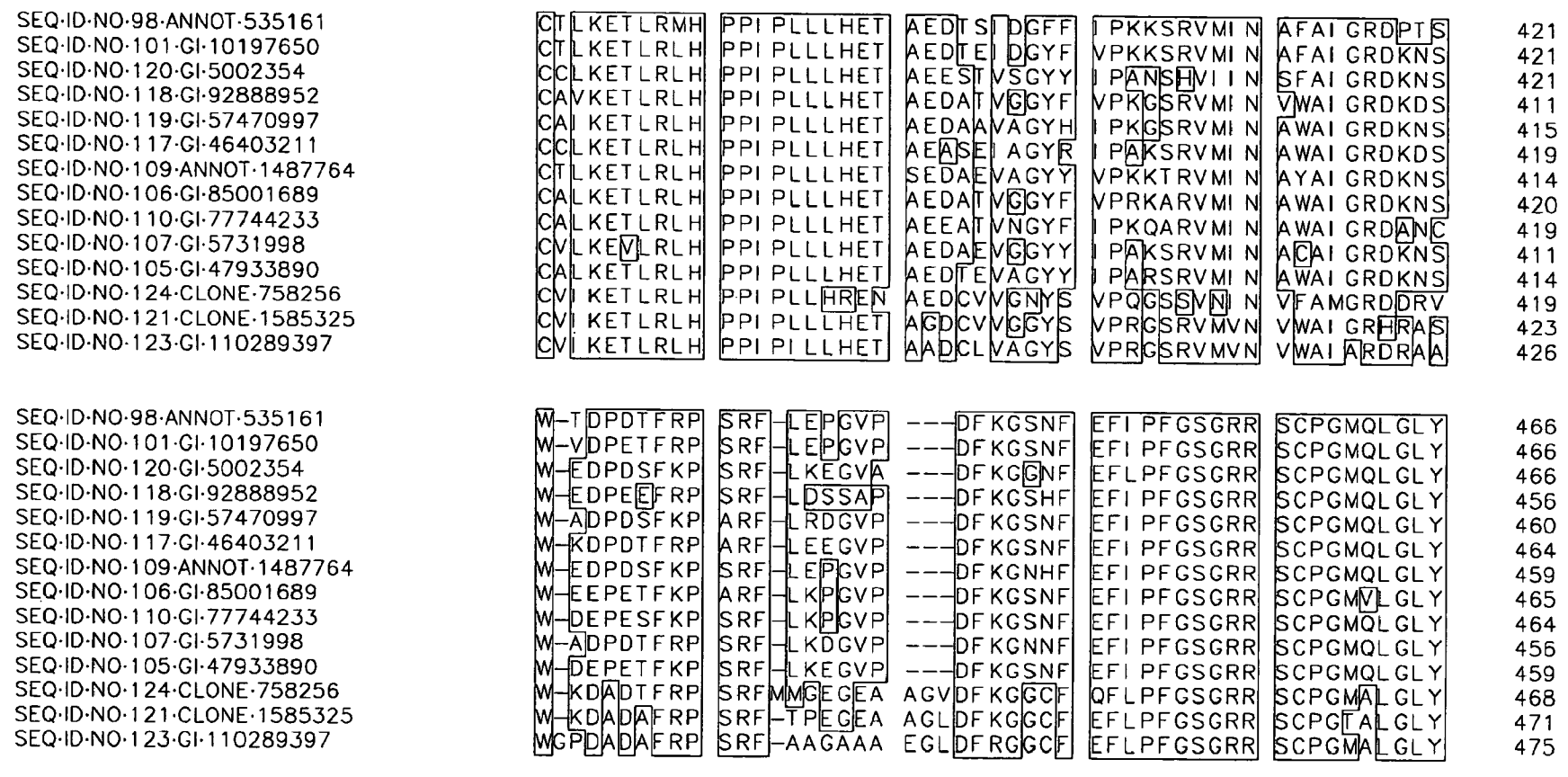
Figure 1F:
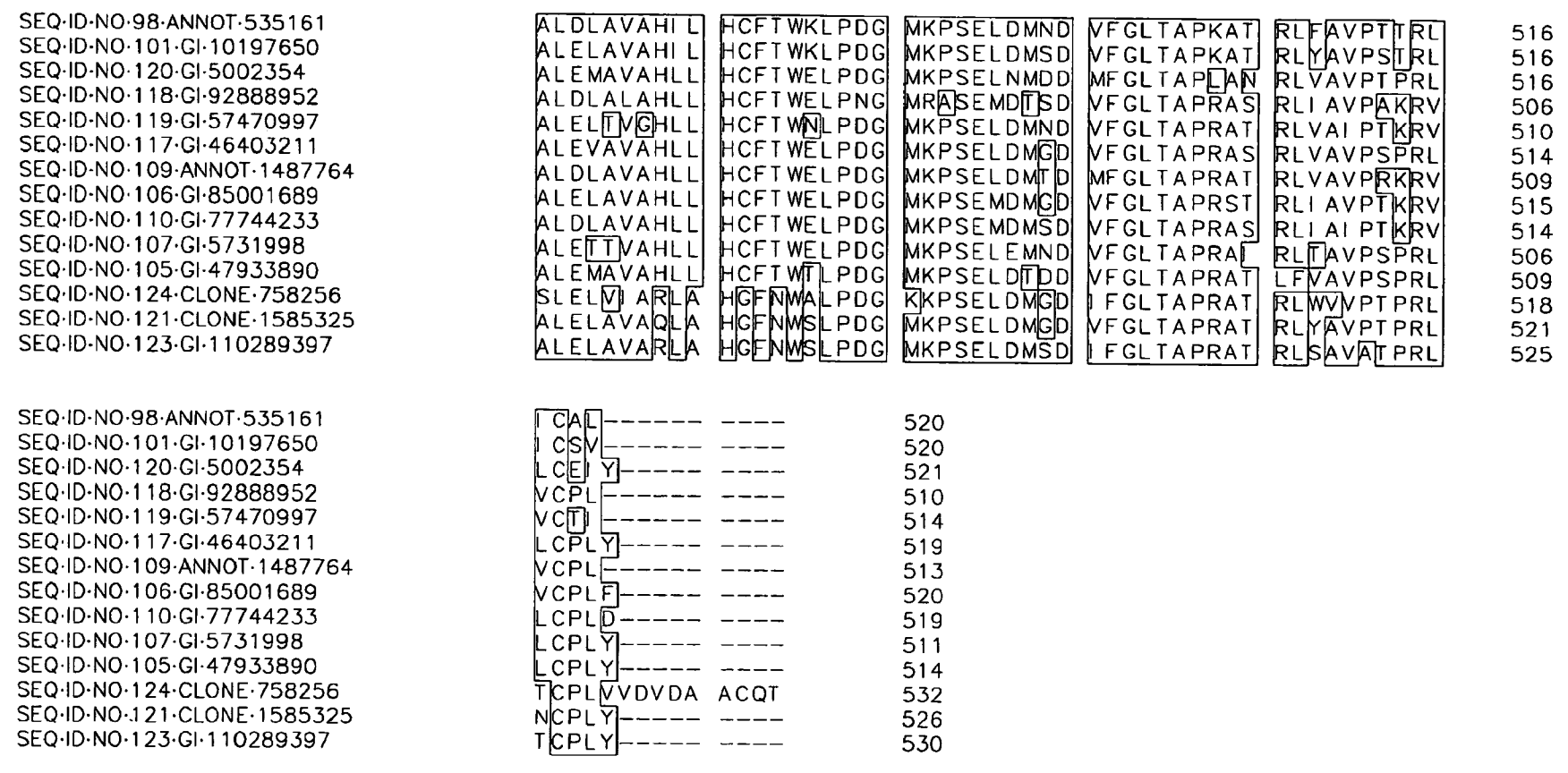

FIGS. 1A-1F are an alignment of the amino acid sequence of Annot ID 535161 (SEQ ID NO:98) with homologous and/or orthologous amino acid sequences gi|10197650 (SEQ ID NO:101), gi|47933890 (SEQ ID NO:105), gi|85001689 (SEQ ID NO:106), gi|5731998 (SEQ ID NO:107), CeresAnnot:1487764 (SEQ ID NO:109), gi|77744233 (SEQ ID NO:110), gi|46403211 (SEQ ID NO:117), gi|92888952 (SEQ ID NO:118), gi|57470997 (SEQ ID NO:119), gi|5002354 (SEQ ID NO:120), CeresClone:1585325 (SEQ ID NO:121), gi|110289397 (SEQ ID NO:123), and CeresClone:758256 (SEQ ID NO:124). FIG. 1 and the other alignment figures provided herein were produced using MUSCLE version 3.52 based on the sequence alignments generated with ProbCon (Do et al., Genome Res., 15(2):330-40 (2005)) version 1.11.

FIGS. 2A-2B are an alignment of the amino acid sequence of Annot ID 837136 (SEQ ID NO:126) with homologous and/or orthologous amino acid sequences CeresAnnot:1491360 (SEQ ID NO:129), gi|50944321 (SEQ ID NO:130), and CeresClone:1784441 (SEQ ID NO:132).

FIGS. 3A-3C are an alignment of the amino acid sequence of Annot ID 860676 (SEQ ID NO:136) with homologous and/or orthologous amino acid sequences CeresClone:1948359 (SEQ ID NO:138), CeresAnnot:1472020 (SEQ ID NO:140), CeresClone:1924069 (SEQ ID NO:142), CeresClone:350091 (SEQ ID NO:143), CeresClone:1791482 (SEQ ID NO:145), gi|50912563 (SEQ ID NO:146), and CeresClone:917285 (SEQ ID NO:147).

Figure 4A:
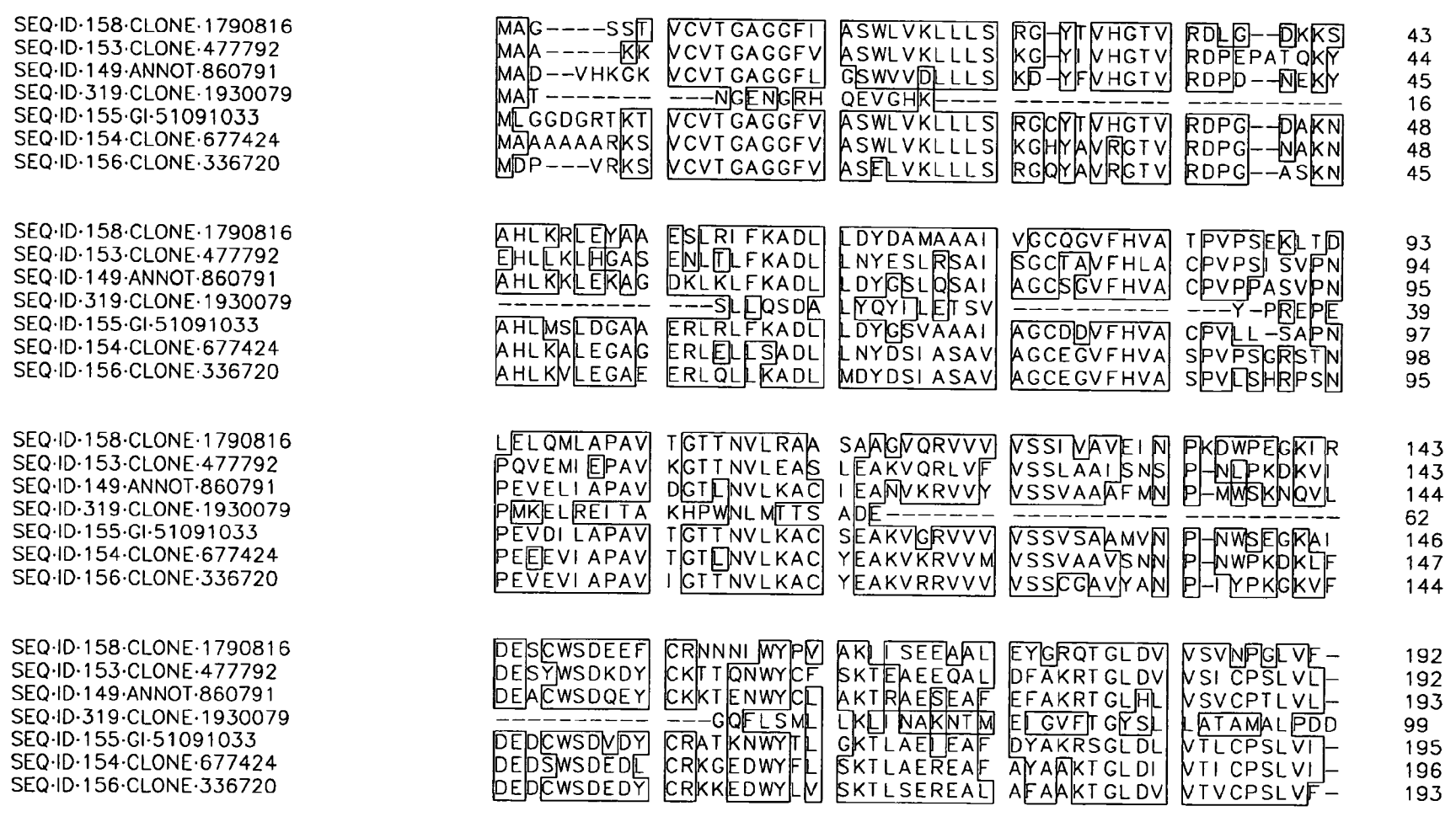

FIGS. 4A-4C are an alignment of the amino acid sequence of Annot ID 860791 (SEQ ID NO:149) with homologous and/or orthologous amino acid sequences CeresClone:477792 (SEQ ID NO:153), CeresClone:677424 (SEQ ID NO:154), gi|51091033 (SEQ ID NO:155), CeresClone:336720 (SEQ ID NO:156), CeresClone:1790816 (SEQ ID NO:158), and Ceres Clone:1930079 (SEQ ID NO:319).

FIGS. 5A-5B are an alignment of the amino acid sequence of Locus At1g08200 (Ceres ANNOT ID no. 863641; SEQ ID NO:160) with homologous and/or orthologous amino acid sequences CeresClone:1459647 (SEQ ID NO:162), Ceres Annot ID:1541782 (SEQ ID NO:165), gi|85718018 (SEQ ID NO:168), gi|37379419 (SEQ ID NO:169), gi|34905954 (SEQ ID NO:171), and gi|92894433 (SEQ ED NO:172).

FIG. 6 is an alignment of the amino acid sequence of Annot ID 867623 (SEQ ID NO:176) with homologous and/or orthologous amino acid sequences CeresClone:873156 (SEQ ID NO:177), gi|83032230 (SEQ ID NO:178), CeresClone:1121732 (SEQ ID NO:180), and gi|92881787 (SEQ ID NO:181).

FIGS. 7A-7B are an alignment of the amino acid sequence of Annot ID 868753 (SEQ ID NO:183) with homologous and/or orthologous amino acid sequences CeresAnnot:1441800 (SEQ ID NO:185), CeresClone:1924705 (SEQ ID NO:187), and CeresClone:624590 (SEQ ID NO:188).

FIGS. 8A-8B are an alignment of the amino acid sequence of Annot ID 870466 (SEQ ID NO:196) with homologous and/or orthologous amino acid sequences gi|90657629 (SEQ ID NO:197), CeresClone:1883580 (SEQ ID NO:199), CeresAnnot:1450185 (SEQ ID NO:201), and gi|50916595 (SEQ ID NO:202).

FIGS. 9A-9B are an alignment of the amino acid sequence of Annot ID 887718 (SEQ ID NO:204) with homologous and/or orthologous amino acid sequences CeresClone:1835843 (SEQ ID NO:206), CeresAnnot:1457442 (SEQ ID NO:208), CeresClone:546224 (SEQ ID NO:211), gi|88604930 (SEQ ID NO:213), and gi|53653786 (SEQ ID NO:214).

FIG. 10 is an alignment of the amino acid sequence of CeresClone 1014844 (SEQ ID NO:218) with homologous and/or orthologous amino acid sequence gi|89257493 (SEQ ID NO:220).

FIGS. 11A-11B are an alignment of the amino acid sequence of CeresClone 11114 (SEQ ID NO:226) with homologous and/or orthologous amino acid sequences CeresClone:464185 (SEQ ID NO:227), gi|47717927 (SEQ ID NO:229), CeresAnnot:1498092 (SEQ ID NO:231), gi|92870641 (SEQ ID NO:234), CeresClone:1277160 (SEQ ID NO:235), gi|606942 (SEQ ID NO:236), gi|86438624 (SEQ ID NO:237), and gi|50947359 (SEQ ID NO:238).

Figure 12A:
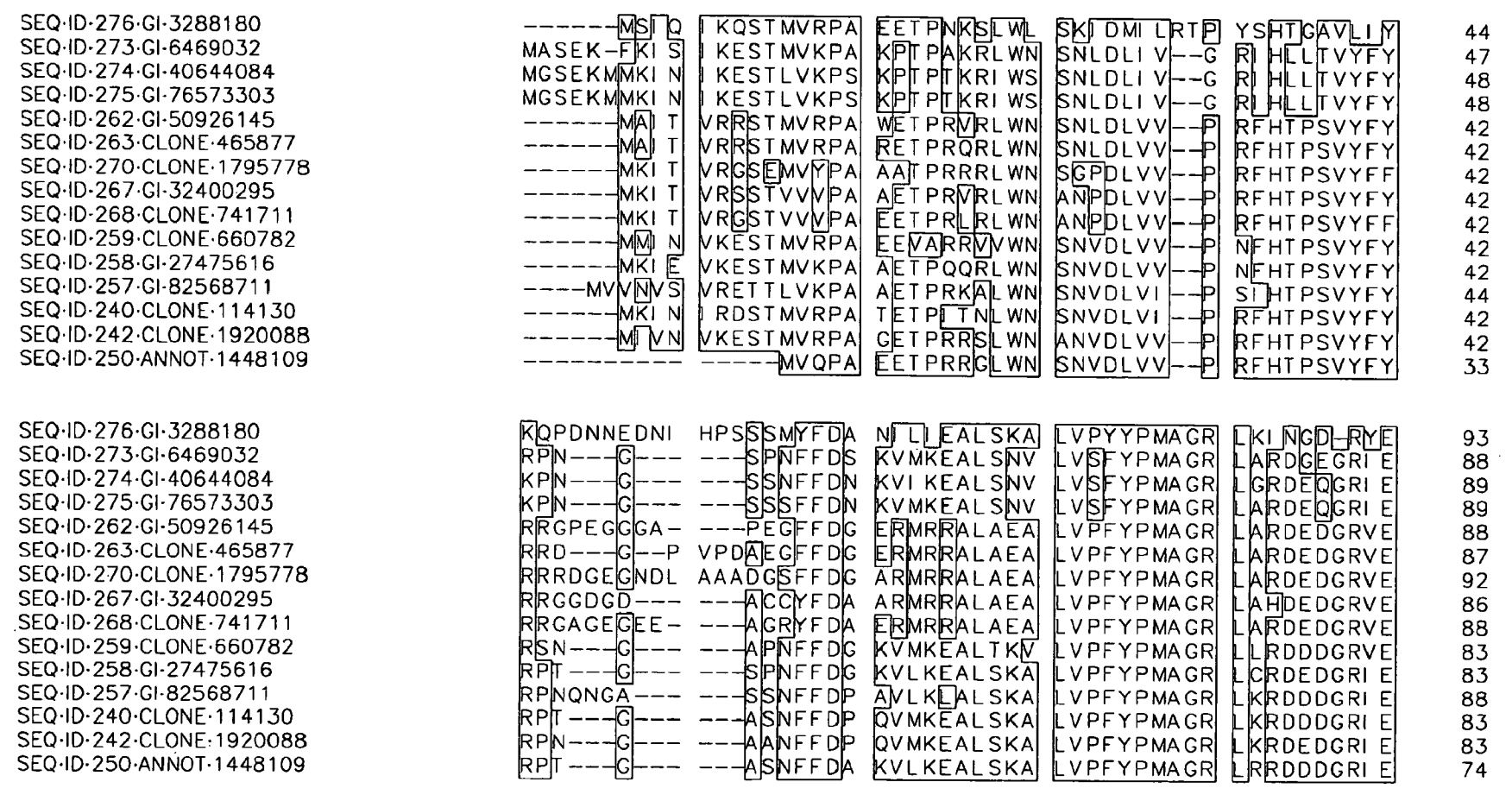
Figure 12B:
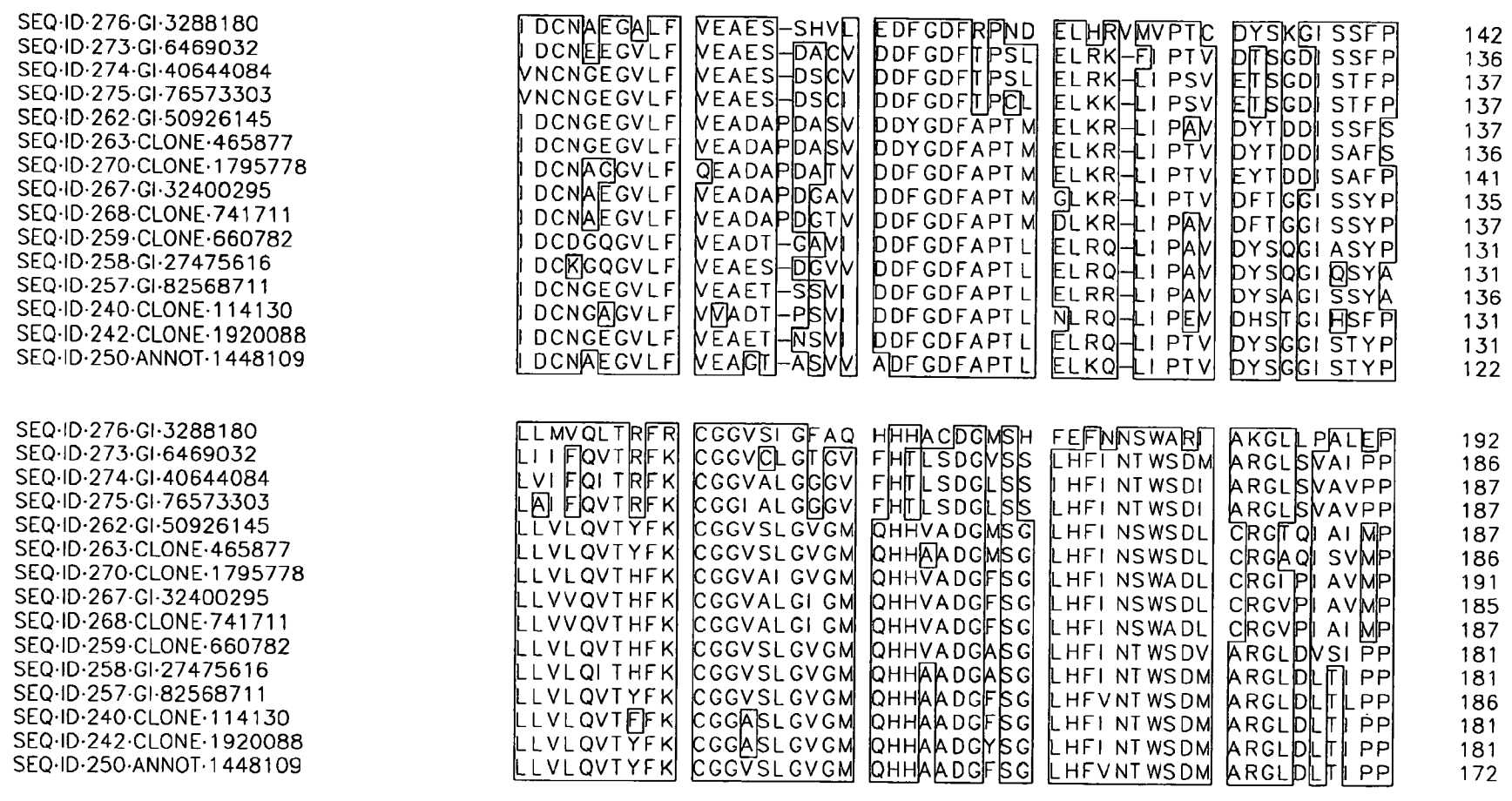
Figure 12C:
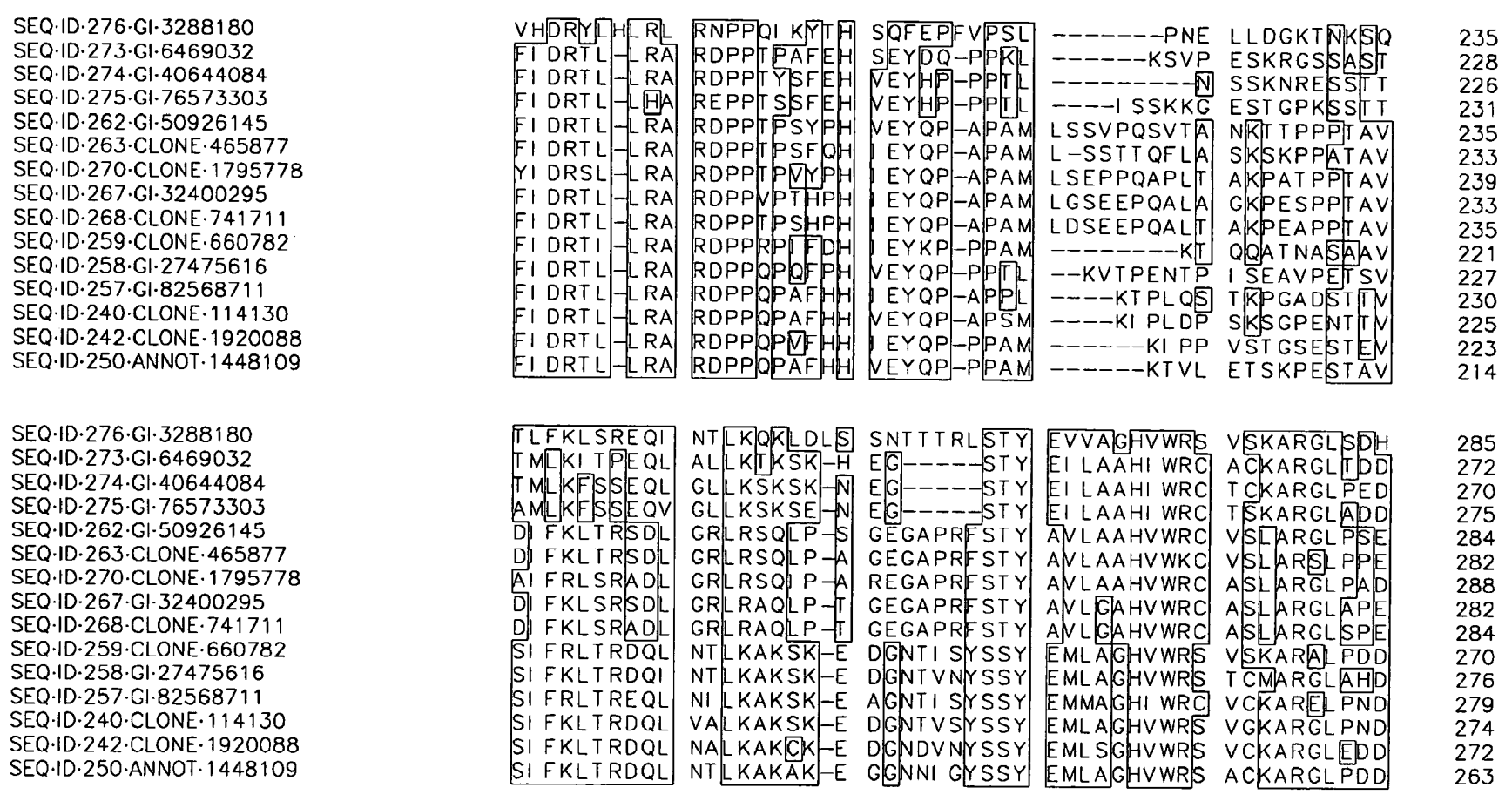
Figure 12D:
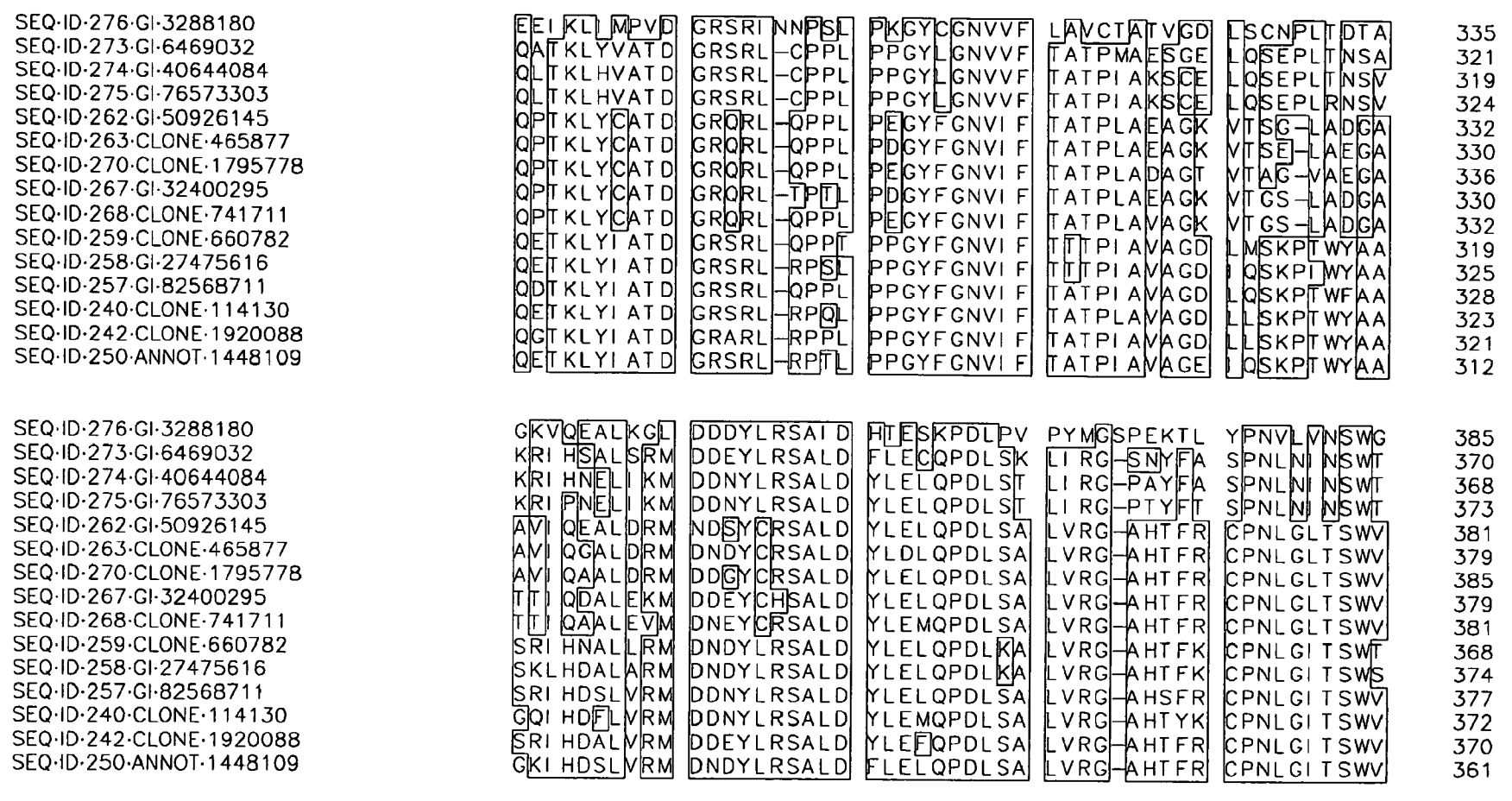

FIGS. 12A-12E are an alignment of the amino acid sequence of CeresClone 114130 (SEQ ID NO:240) with homologous and/or orthologous amino acid sequences CeresClone:1920088 (SEQ ID NO:242), CeresAnnot:1448109 (SEQ ID NO:250), gi|82568711 (SEQ ID NO:257), gi|27475616 (SEQ ID NO:258), CeresClone:660782 (SEQ ID NO:259), gi|50926145 (SEQ ID NO:262), CeresClone:465877 (SEQ ID NO:263), gi|32400295 (SEQ ID NO:267), CeresClone:741711 (SEQ ID NO:268), CeresClone:1795778 (SEQ ID NO:270), gi|6469032 (SEQ ID NO:273), gi|40644084 (SEQ ID NO:274), gi|76573303 (SEQ ID NO:275), and gi|3288180 (SEQ ID NO:276).

FIG. 13 is an alignment of the amino acid sequence of CeresClone 38915 (SEQ ID NO:286) with homologous and/or orthologous amino acid sequence CeresClone:1375697 (SEQ ID NO:287).

Figure 14A:
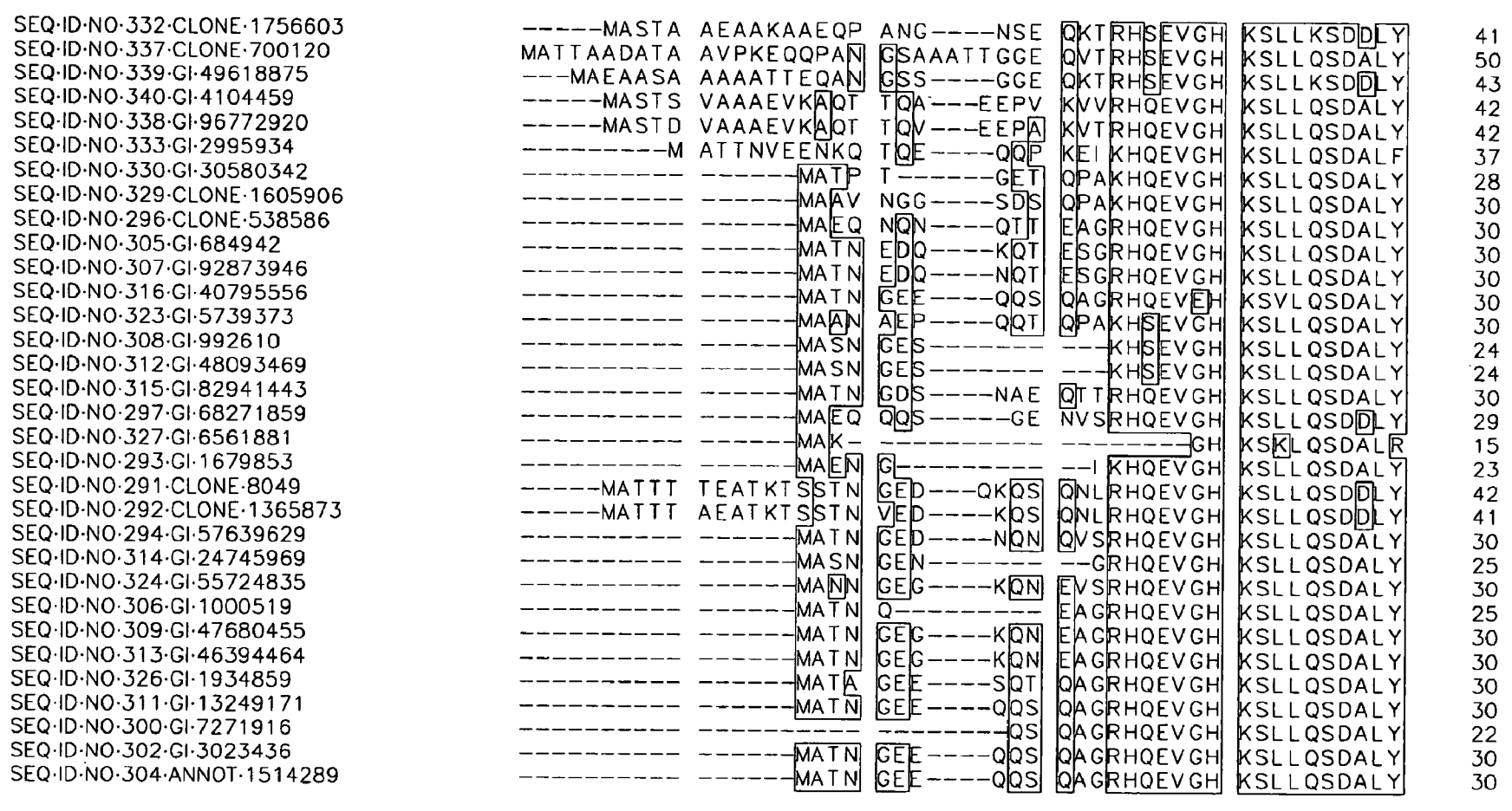
Figure 14D:
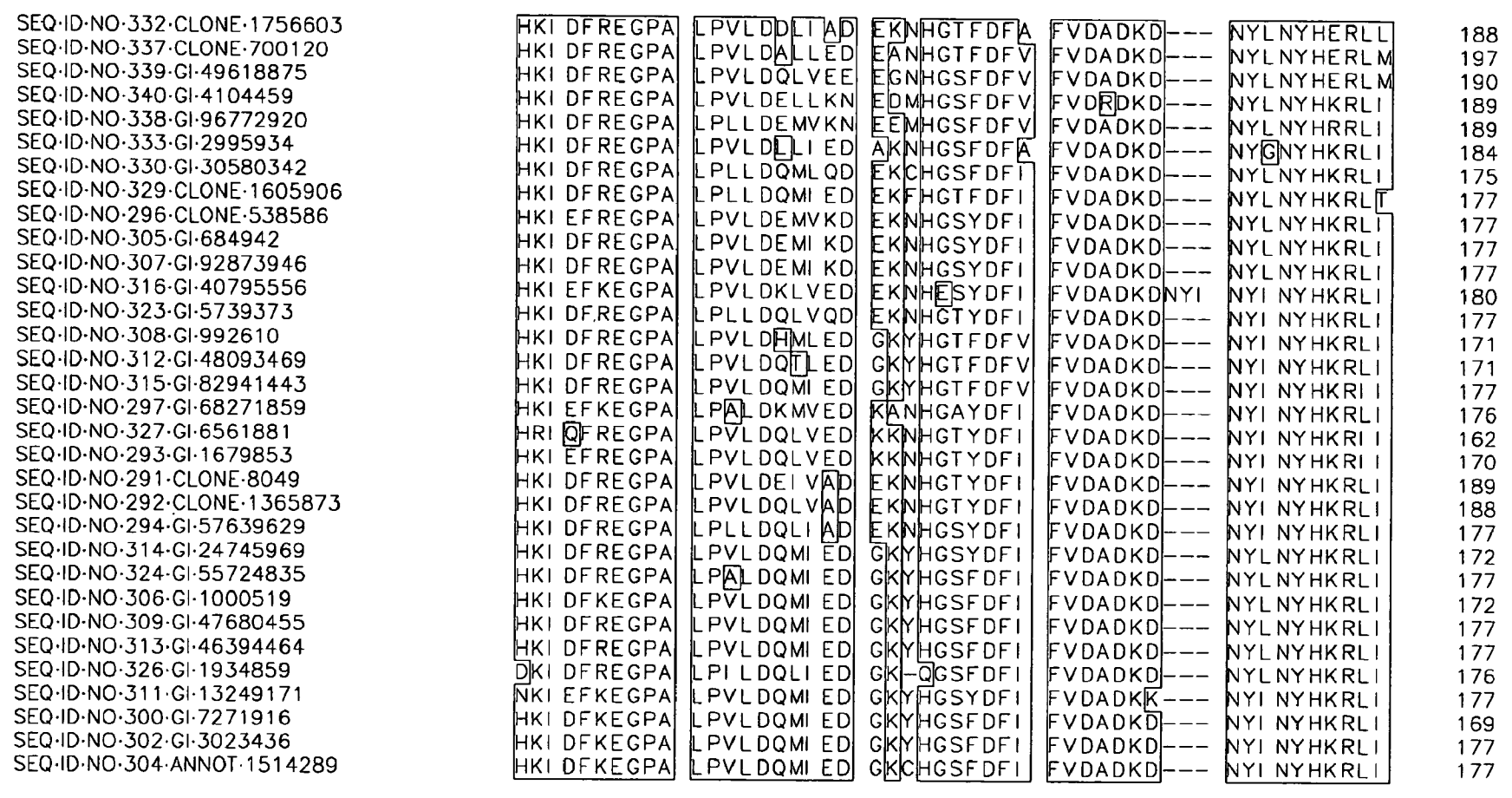
Figure 14E:
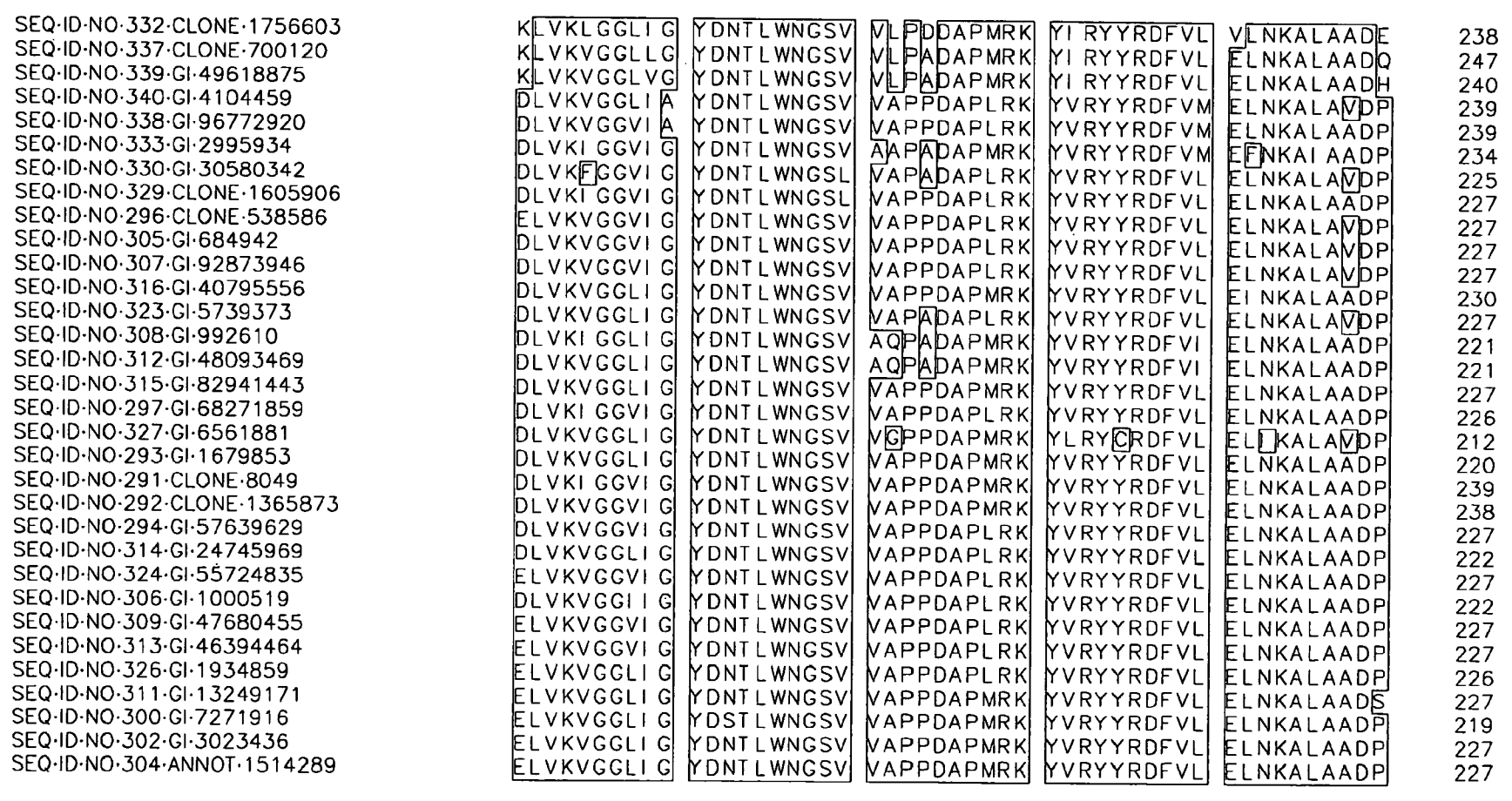

FIGS. 14A-14F are an alignment of the amino acid sequence of CeresClone 8049 (SEQ ID NO:291) with homologous and/or orthologous amino acid sequences CeresClone:1365873 (SEQ ID NO:292), gi|1679853 (SEQ ID NO:293), gi|57639629 (SEQ ID NO:294), CeresClone:538586 (SEQ ID NO:296), gi|68271859 (SEQ ID NO:297), gi|7271916 (SEQ ID NO:300), gi|3023436 (SEQ ID NO:302), CeresAnnot:1514289 (SEQ ID NO:304), gi|684942 (SEQ ID NO:305), gi|1000519 (SEQ ID NO:306), gi|92873946 (SEQ ID NO:307), gi|992610 (SEQ ID NO:308), gi|47680455 (SEQ ID NO:309), gi|13249171 (SEQ ID NO:311), gi|48093469 (SEQ ID NO:312), gi|46394464 (SEQ ID NO:313), gi|24745969 (SEQ ID NO:314), gi|82941443 (SEQ ID NO:315), gi|40795556 (SEQ ID NO:316), gi|5739373 (SEQ ID NO:323), gi|55724835 (SEQ ID NO:324), gi|1934859 (SEQ ID NO:326), gi|6561881 (SEQ ID NO:327), CeresClone:1605906 (SEQ ID NO:329), gi|30580342 (SEQ ID NO:330), CeresClone:1756603 (SEQ ID NO:332), gi|2995934 (SEQ ID NO:333), CeresClone:700120 (SEQ ID NO:337), gi|96772920 (SEQ ID NO:338), gi|49618875 (SEQ ID NO:339), and gi|4104459 (SEQ ID NO:340).

Figure 15A:
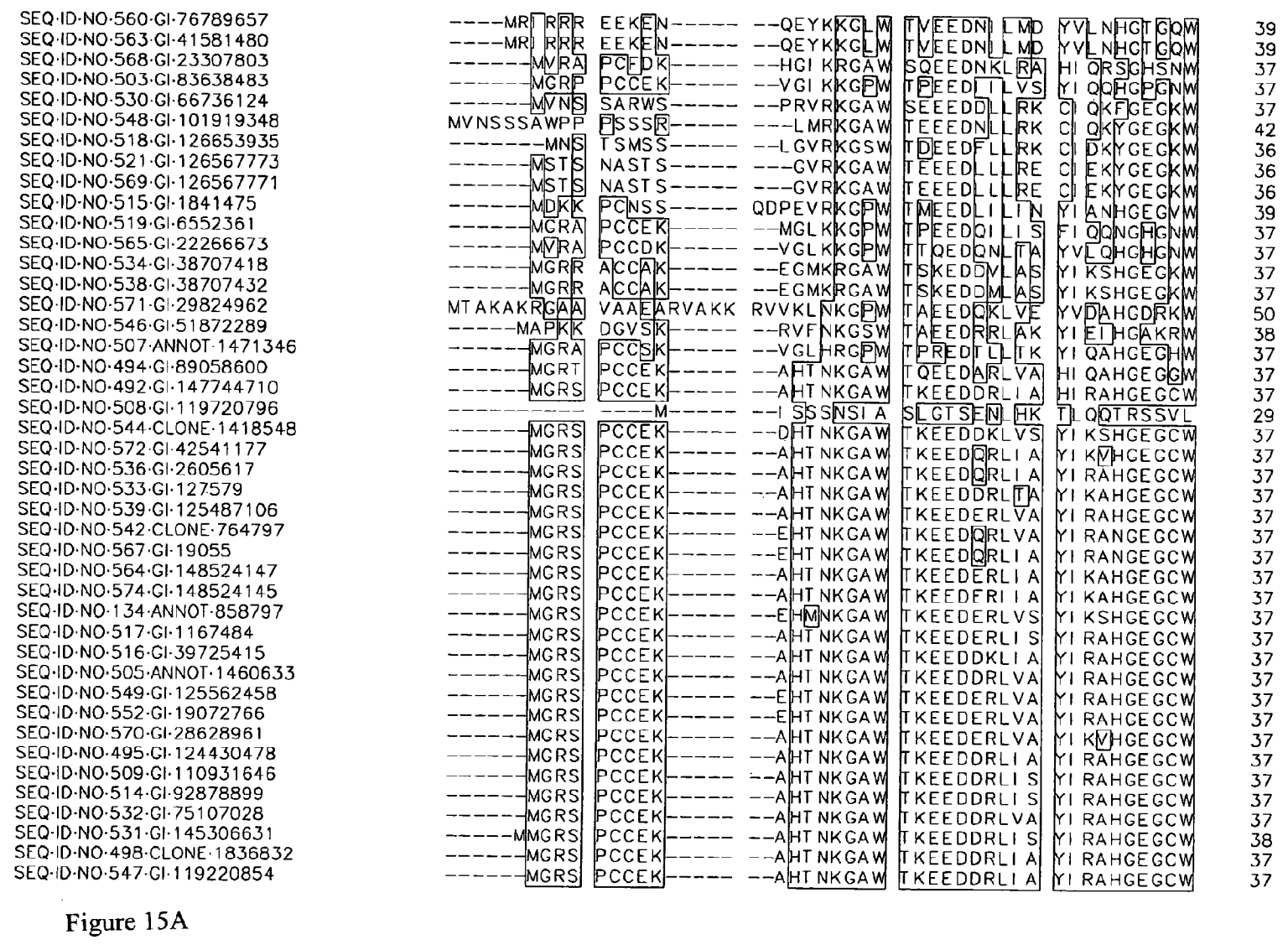
Figure 15B:
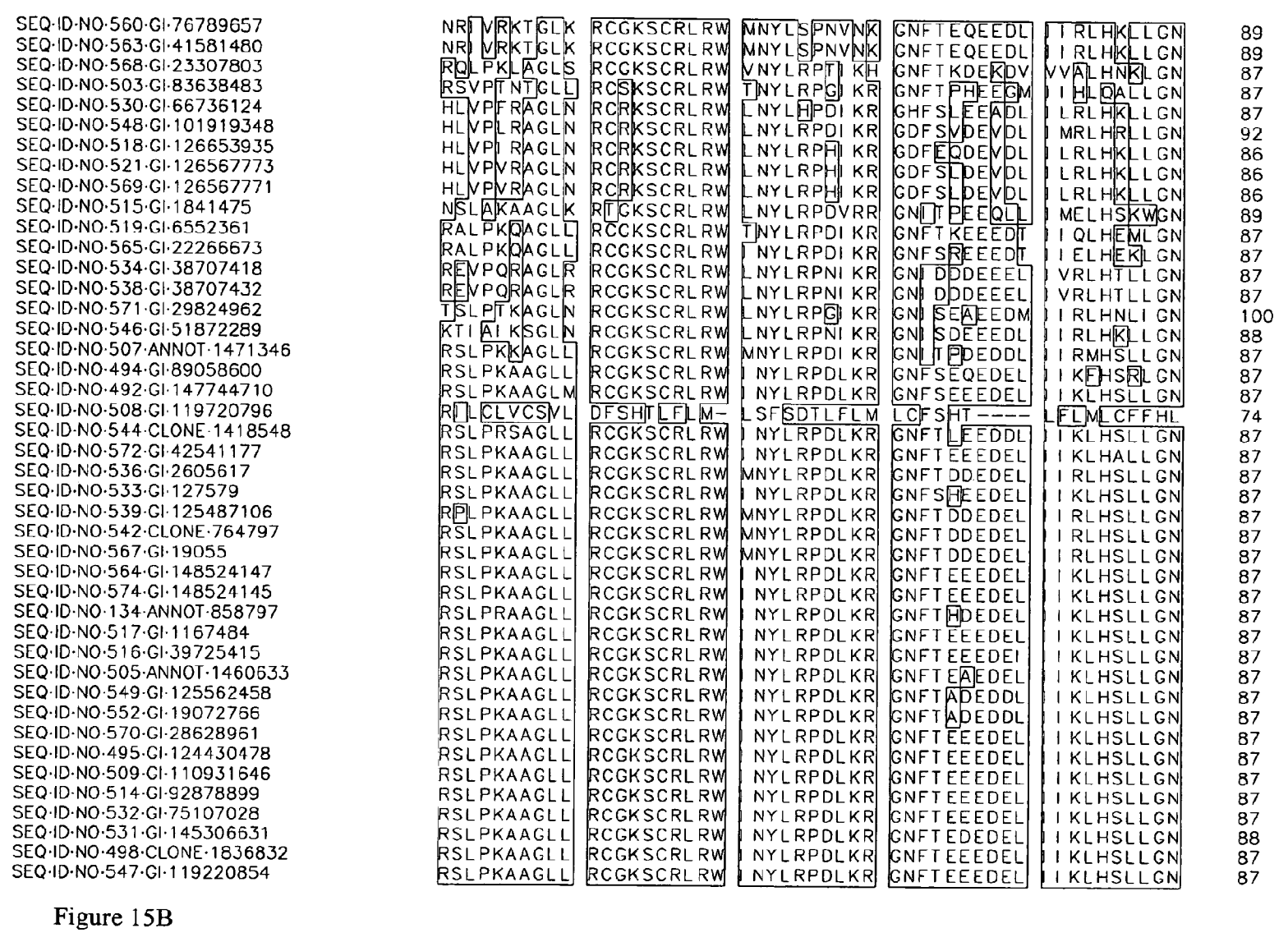
Figure 15C:
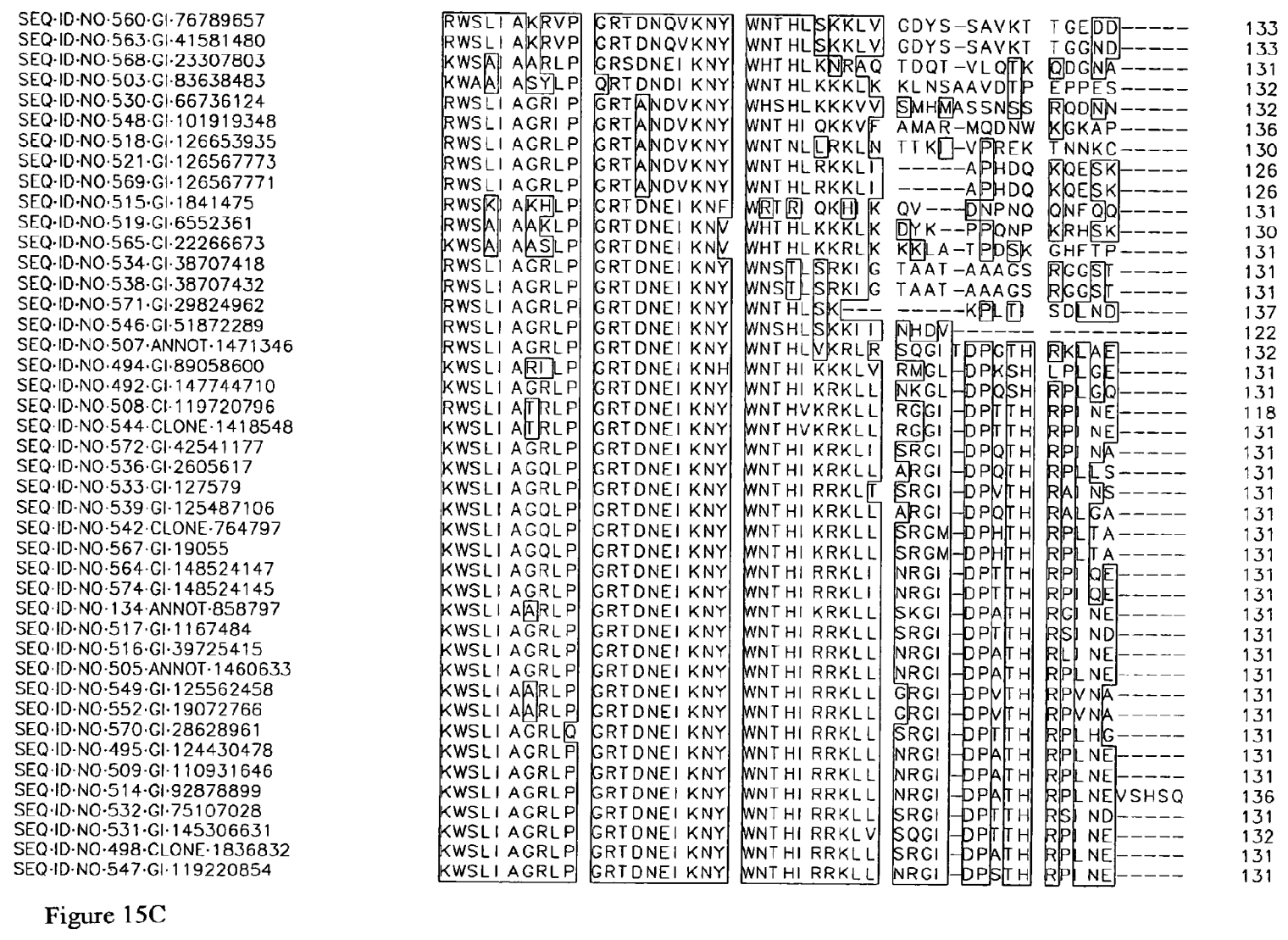
Figure 15D:
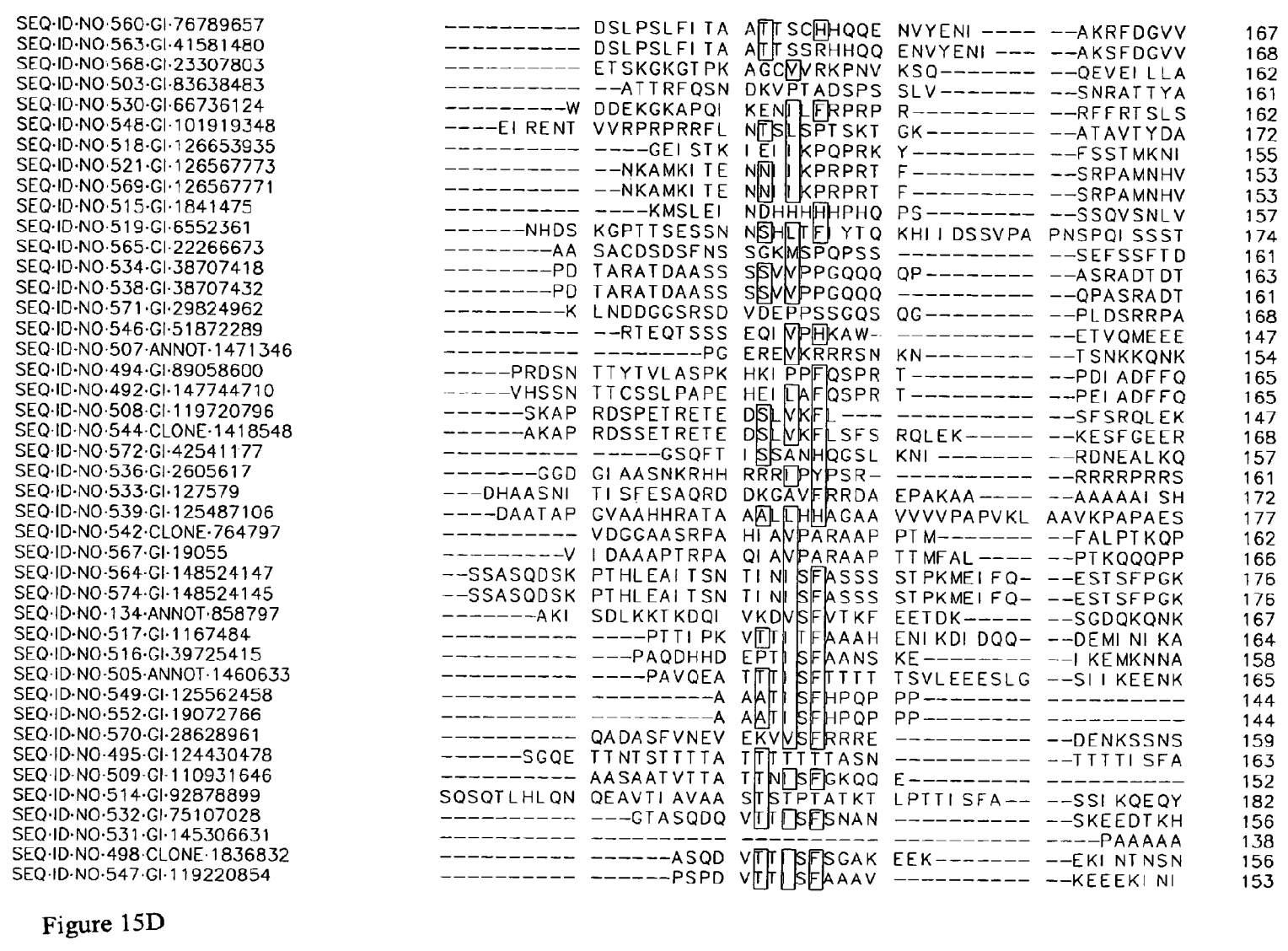
Figure 15E:
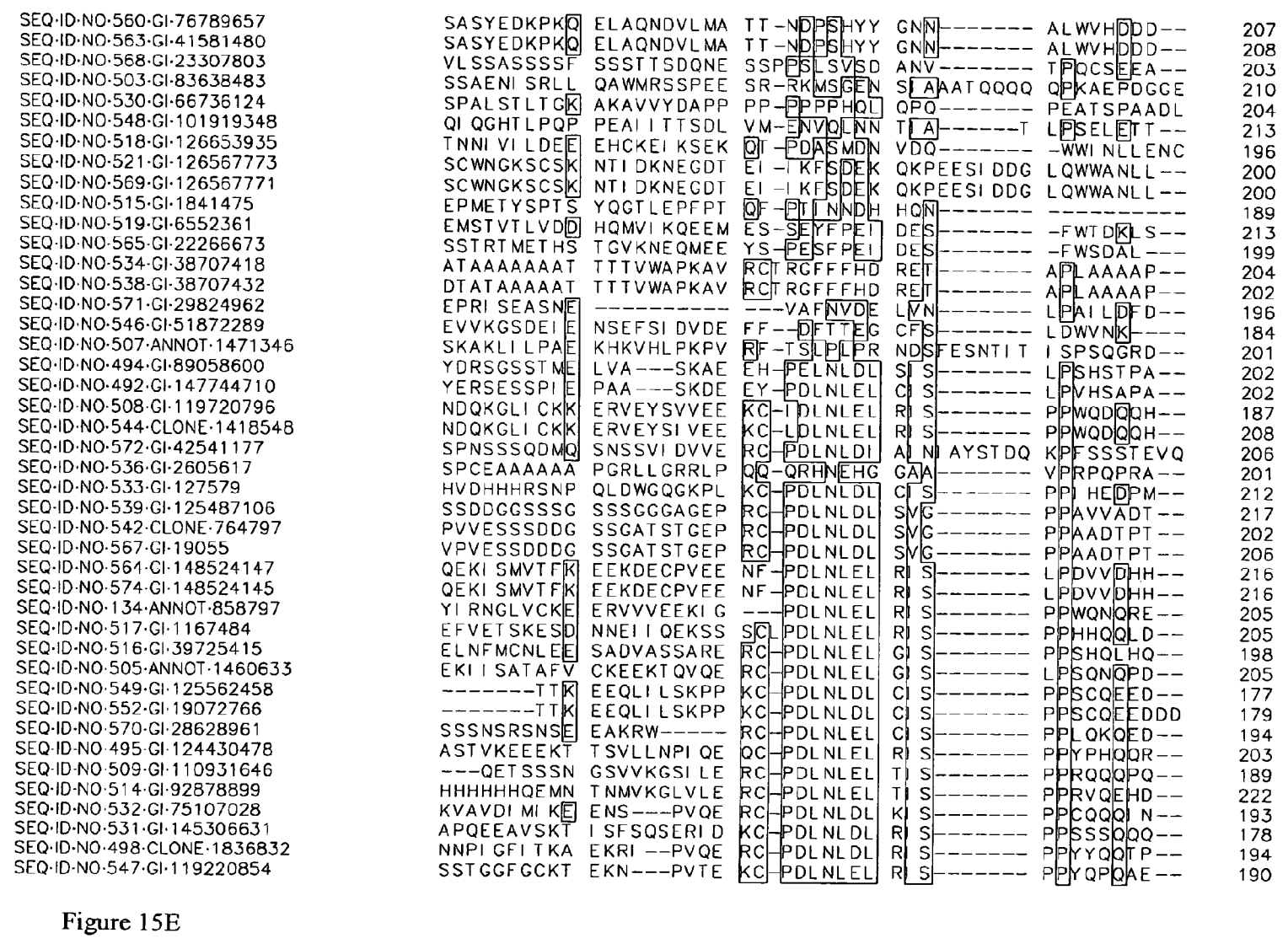
Figure 15F:
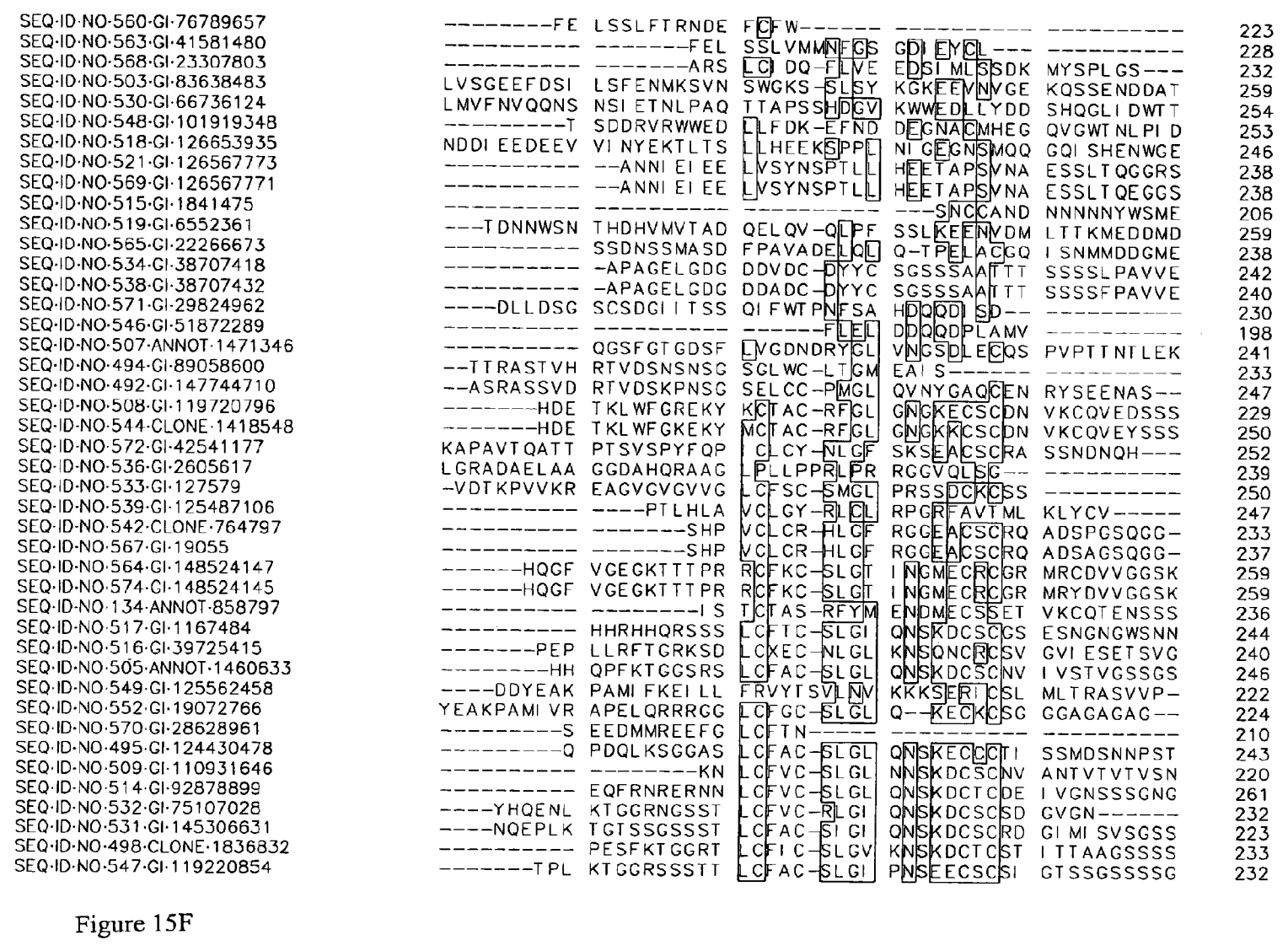

FIGS. 15A-15G are an alignment of the amino acid sequence of Annot. ID 858797 (SEQ ID NO:134) with homologous and/or orthologous amino acid sequences gi|147744710 (SEQ ID NO:492), gi|89058600 (SEQ ID NO:494), gi|124430478 (SEQ ID NO:495), CeresClone 1836832 (SEQ ID NO:498), gi|83638483 (SEQ ID NO:503), Annot. ID 460633 (SEQ ID NO:505), Annot. ID 1471346 (SEQ ID NO:507), gi|119720796 (SEQ ID NO:508), gi|110931646 (SEQ ID NO:509), gi|92878899 (SEQ ID NO:514), gi|1841475 (SEQ ID NO:515), gi|39725415 (SEQ ID NO:516), gi|1167484 (SEQ ID NO:517), gi|126653935 (SEQ ID NO:518), gi|6552361 (SEQ ID NO:519), gi|126567773 (SEQ ID NO:521), gi|66736124 (SEQ ID NO:530), gi|145306631 (SEQ ID NO:531), gi|75107028 (SEQ ID NO:532), gi|127579 (SEQ ID NO:533), gi|38707418 (SEQ ID NO:534), gi|2605617 (SEQ ID NO:536), gi|38707432 (SEQ ID NO:538), gi|125487106 (SEQ ID NO:539), CeresClone 764797 (SEQ ID NO:542), CeresClone 1418548 (SEQ ID NO:544), gi|51872289 (SEQ ID NO:546), gi|119220854 (SEQ ID NO:547), gi|101919348 (SEQ ID NO:548), gi|125562458 (SEQ ID NO:549), gi|9072766 (SEQ ID NO:552), gi|76789657 (SEQ ID NO:560), gi|41581480 (SEQ ID NO:563), gi|148524147 (SEQ ID NO:564), gi|22266673 (SEQ ID NO:565), gi|19055 (SEQ ID NO:567), gi|23307803 (SEQ ID NO:568), gi|126567771 (SEQ ID NO:569), gi|28628961 (SEQ ID NO:570), gi|29824962 (SEQ ID NO:571), gi|42541177 (SEQ ID NO:572), and gi|148524145 (SEQ ID NO:574).

FIGS. 17A-17R are an alignment of the amino acid sequence of Annot ID 1365873 (SEQ ID NO:192) with gi|56605372 (SEQ ID NO:665), gi|4574324 (SEQ ID NO:666), gi|1777386 (SEQ ID NO:668), gi|24212392 (SEQ ID NO:669), gi|87887871 (SEQ ID NO:670), gi|33286376 (SEQ ID NO:671), gi|1170555 (SEQ ID NO:672), CeresClone 1847526 (SEQ ID NO:676), gi|231757 (SEQ ID NO:677), Annot ID 1521032 (SEQ ID NO:680), gi|7332271 (SEQ ID NO:683), gi|27808586 (SEQ ID NO:685), CeresClone 3828 (SEQ ID NO:687), CeresClone 1086143 (SEQ ID NO:689), gi|6760443 (SEQ ID NO:692), gi|114199044 (SEQ ID NO:693), gi|3913295 (SEQ ID NO:697), gi|116908 (SEQ ID NO:698), gi|92878636 (SEQ ID NO:699), gi|1169009 (SEQ ID NO:700), gi|29839377 (SEQ ID NO:701), gi|12003964 (SEQ ID NO:702), gi|396589 (SEQ ID NO:704), gi|5732000 (SEQ ID NO:706), gi|27531337 (SEQ ID NO:707), gi|2388664 (SEQ ID NO:708), gi|29839259 (SEQ ID NO:711), gi|18033964 (SEQ ID NO:712), gi|77818928 (SEQ ID NO:714), CeresClone 1453701 (SEQ ID NO:719), gi|14578615 (SEQ ID NO:720), gi|7271883 (SEQ ID NO:724), gi|29839290 (SEQ ID NO:725), gi|38047397 (SEQ ID NO:726), gi|29839288 (SEQ ID NO:727), gi|1582580 (SEQ ID NO:729), gi|57157826 (SEQ ID NO:730), gi|567077 (SEQ ID NO:733), CeresClone 1869486 (SEQ ID NO:739), gi|29839421 (SEQ ID NO:742), gi|125560205 (SEQ ID NO:744), gi|38565551 (SEQ ID NO:748), gi|22652500 (SEQ ID NO:749), gi|89113191 (SEQ ID NO:751), gi|29839344 (SEQ ID NO:754) gi|4808524 (SEQ ID NO:755), gi|29839258 (SEQ ID NO:760), gi|109255537 (SEQ ID NO:761), gi|7528266 (SEQ ID NO:762), gi|34398680 (SEQ ID NO:763), and gi|47232556 (SEQ ID NO:766).

Figure 18A:
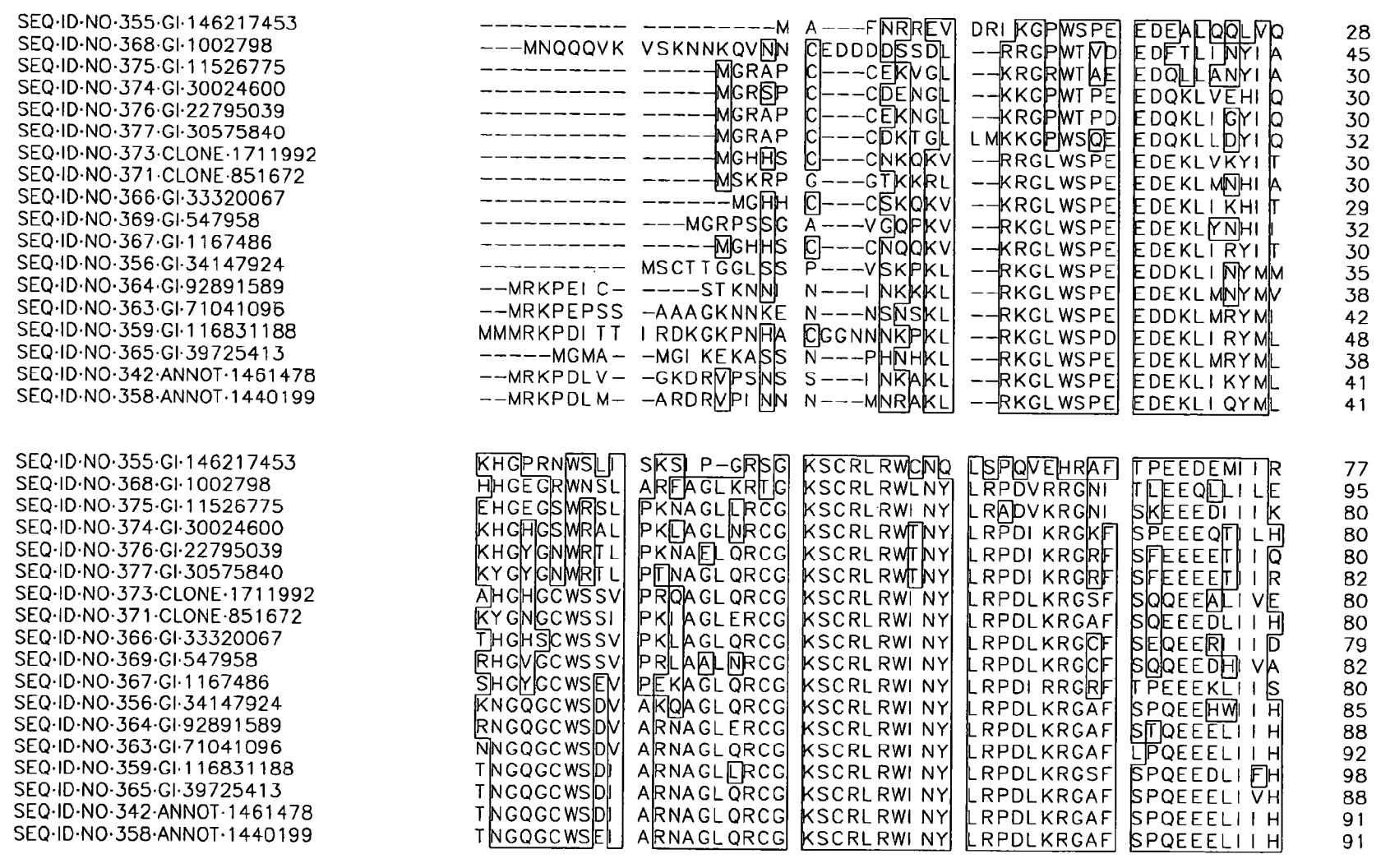
Figure 18B:
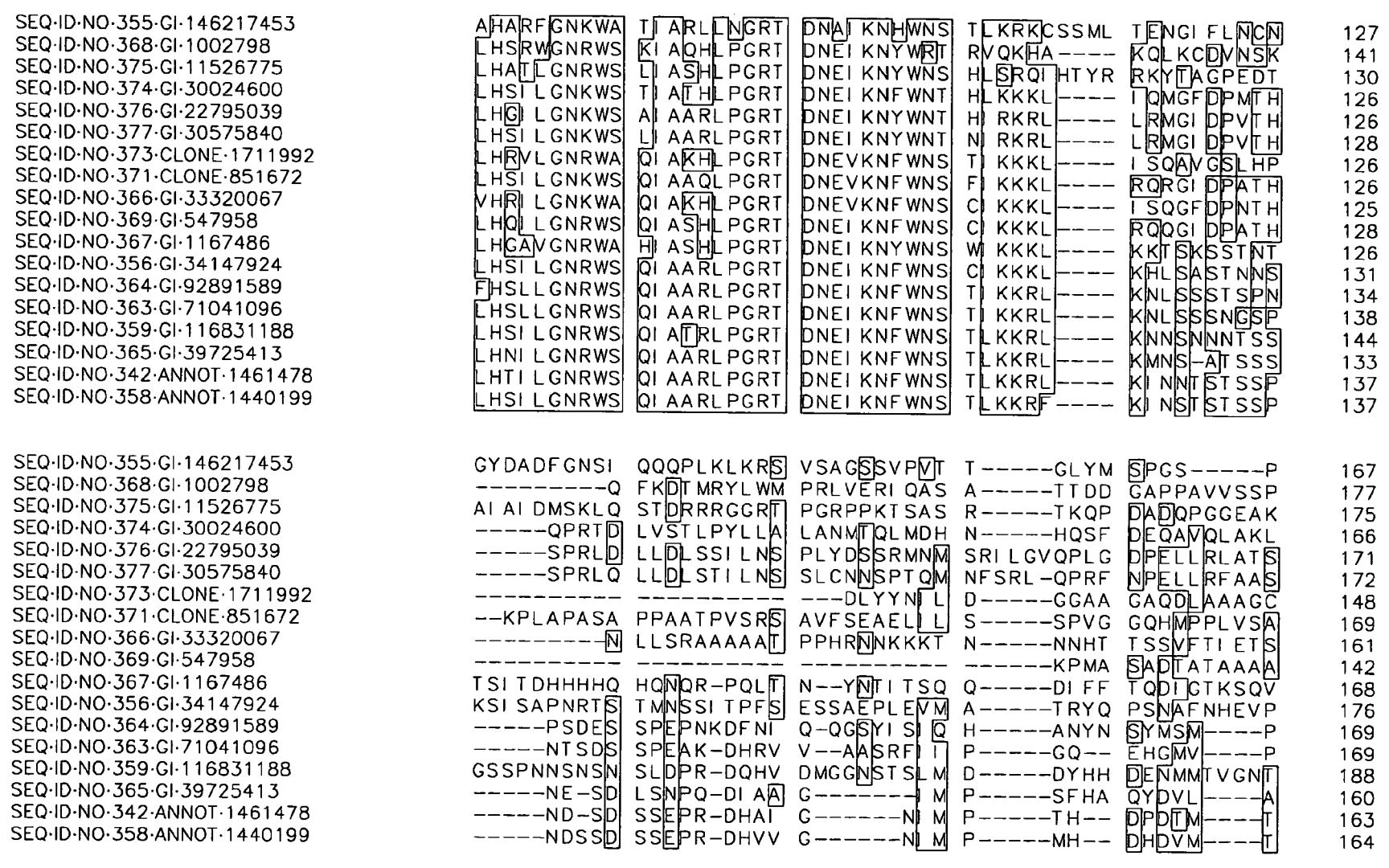
Figure 18C:
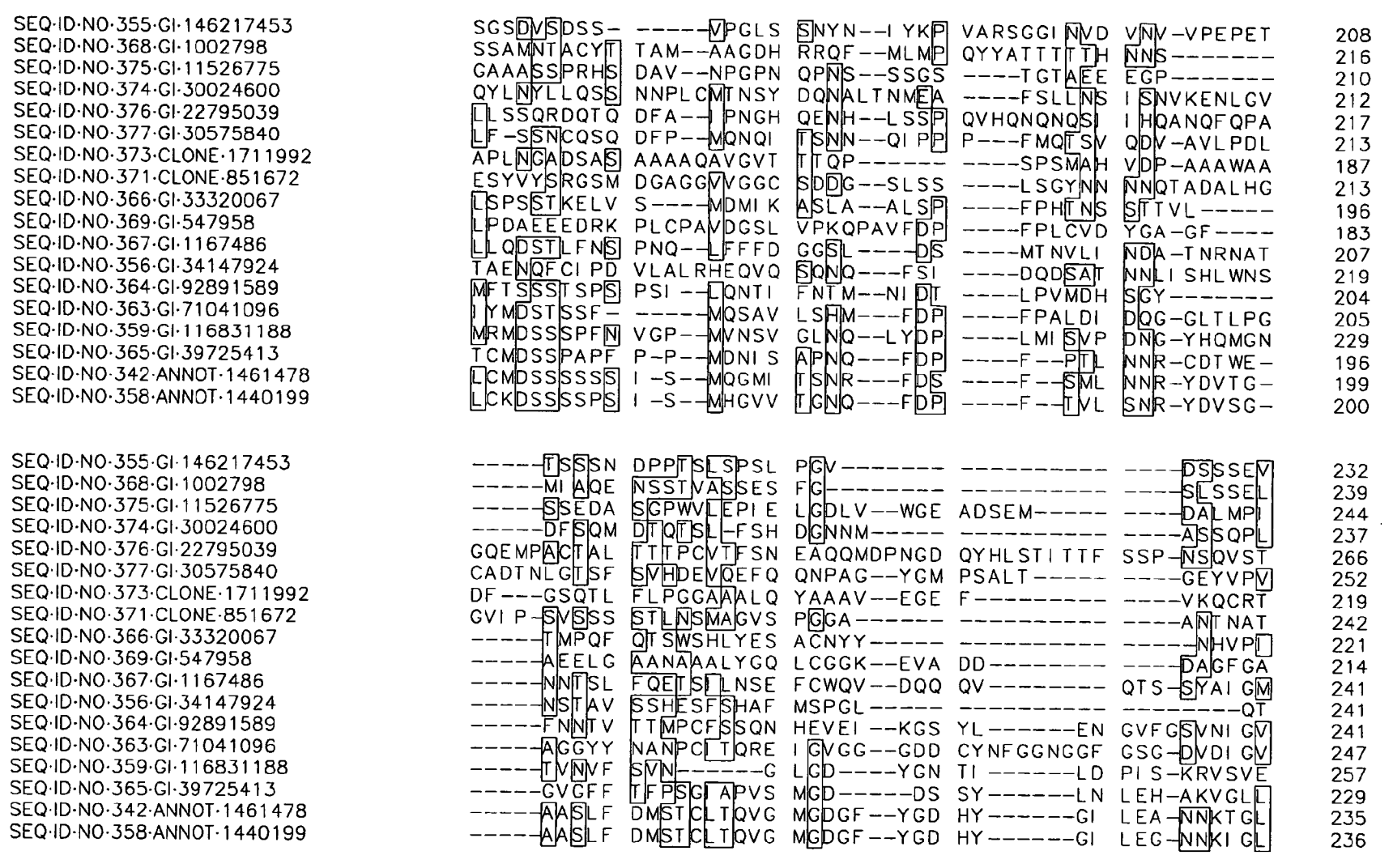
Figure 18D:
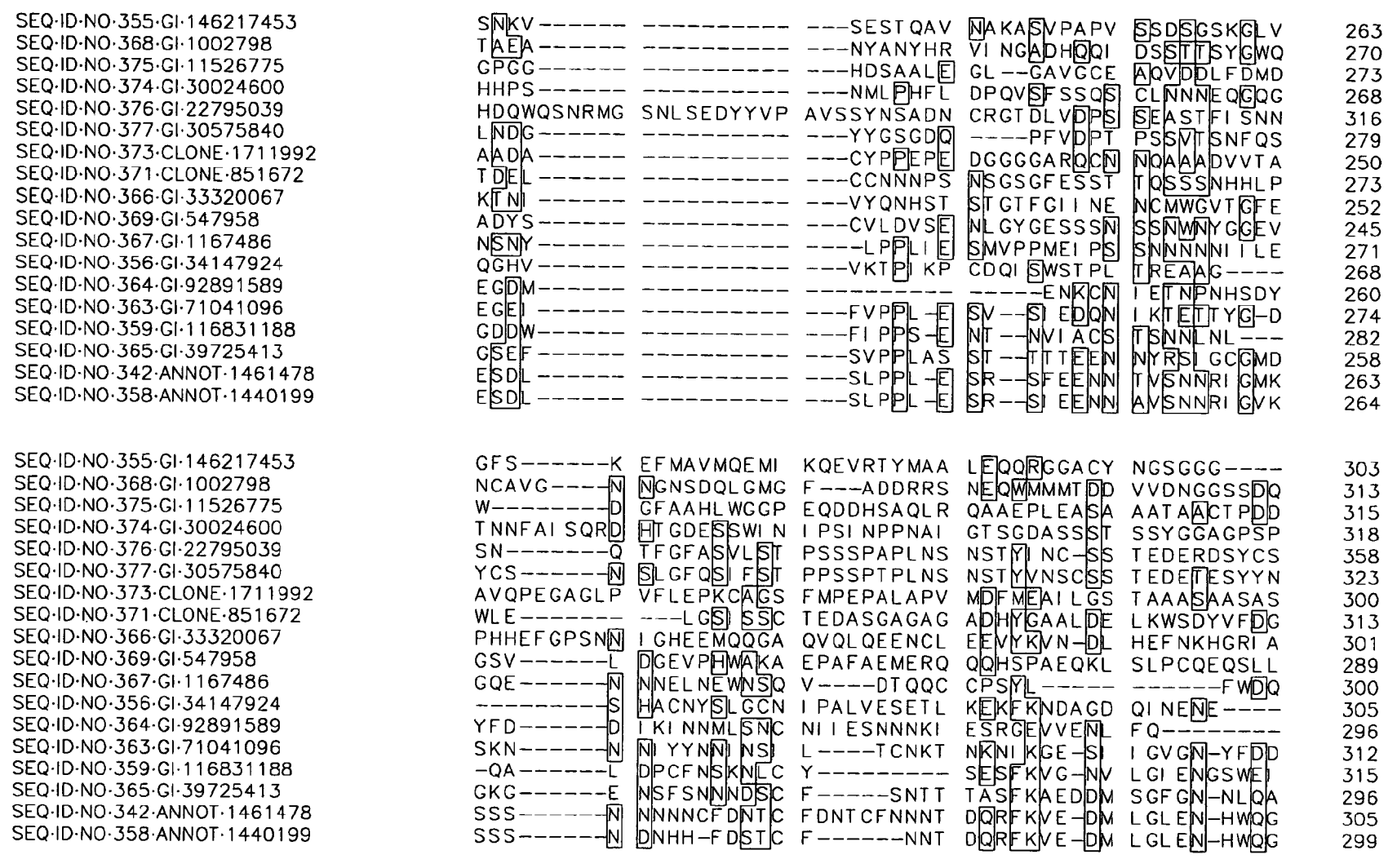

FIGS. 18A-18E are an alignment of the amino acid sequence of Annot ID 1461478 (SEQ ID NO:342) with homologous and/or orthologous amino acid sequences gi|146217453 (SEQ ID NO:355), gi|34147924 (SEQ ID NO:356), Annot ID 1440199 (SEQ ID NO:358), gi|116831188 (SEQ ID NO:359), gi|71041096 (SEQ ID NO:363), gi|92891589 (SEQ ID NO:364), gi|39725413 (SEQ ID NO:365), gi|33320067 (SEQ ID NO:366), gi|1167486 (SEQ ID NO:367), gi|1002798 (SEQ ID NO:368), gi|547958 (SEQ ID NO:369), CeresClone 851672 (SEQ ID NO:371), CeresClone 1711992 (SEQ ID NO:373), gi|30024600 (SEQ ID NO:374), gi|11526775 (SEQ ID NO:375), gi|22795039 (SEQ ID NO:376), and gi|30575840 (SEQ ID NO:377).

Figure 20A:
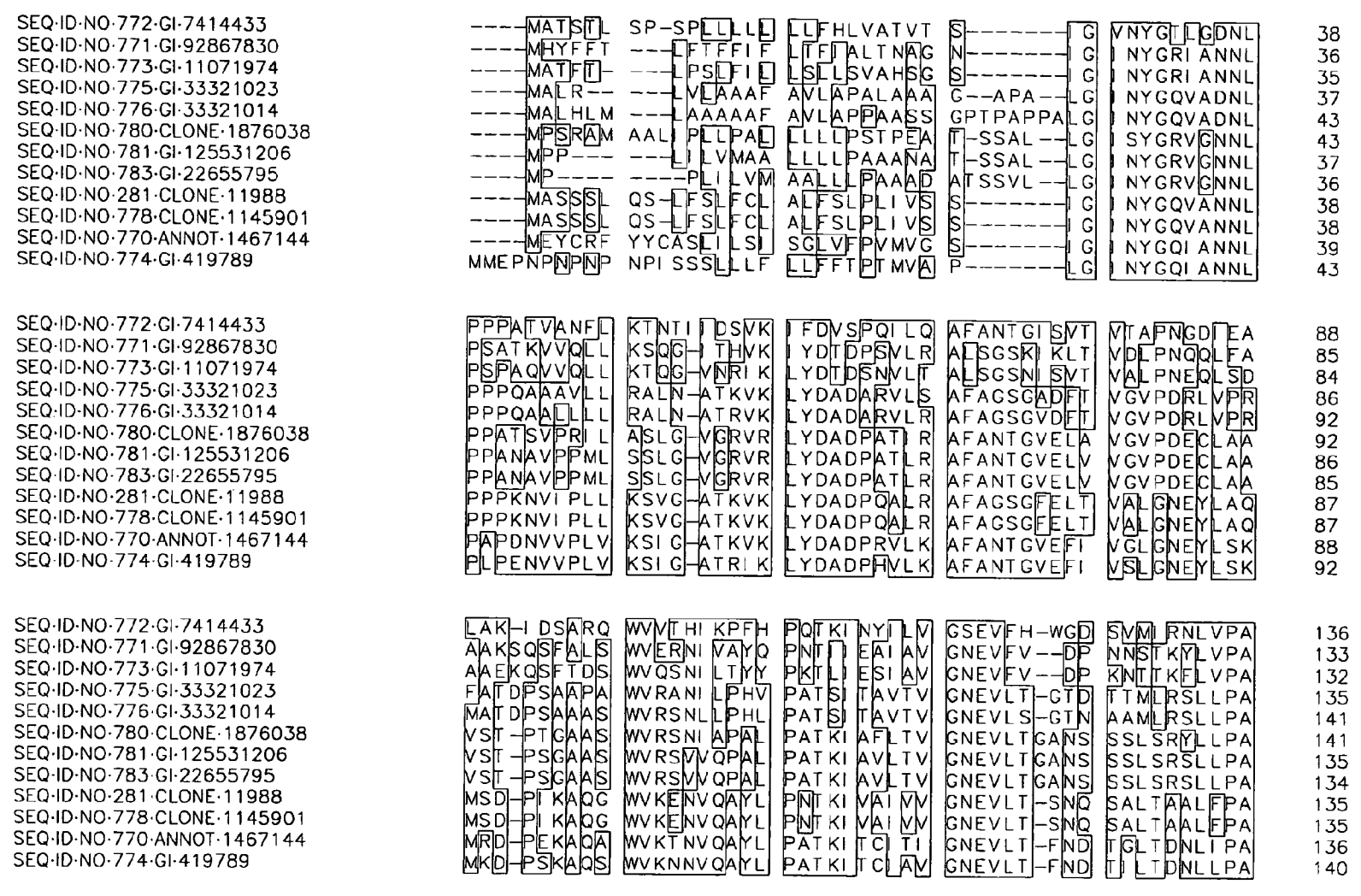
Figure 20B:
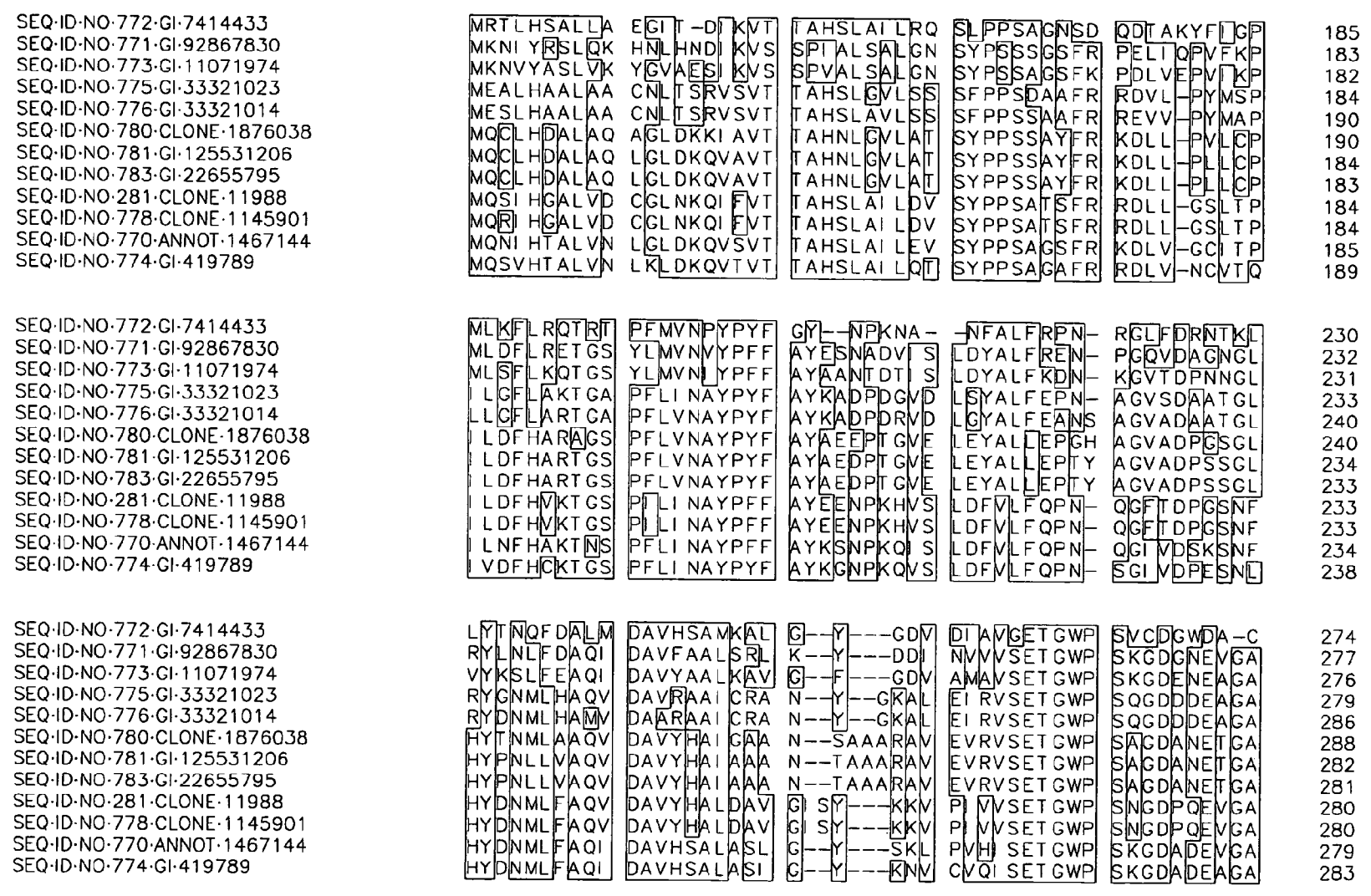
Figure 20C:
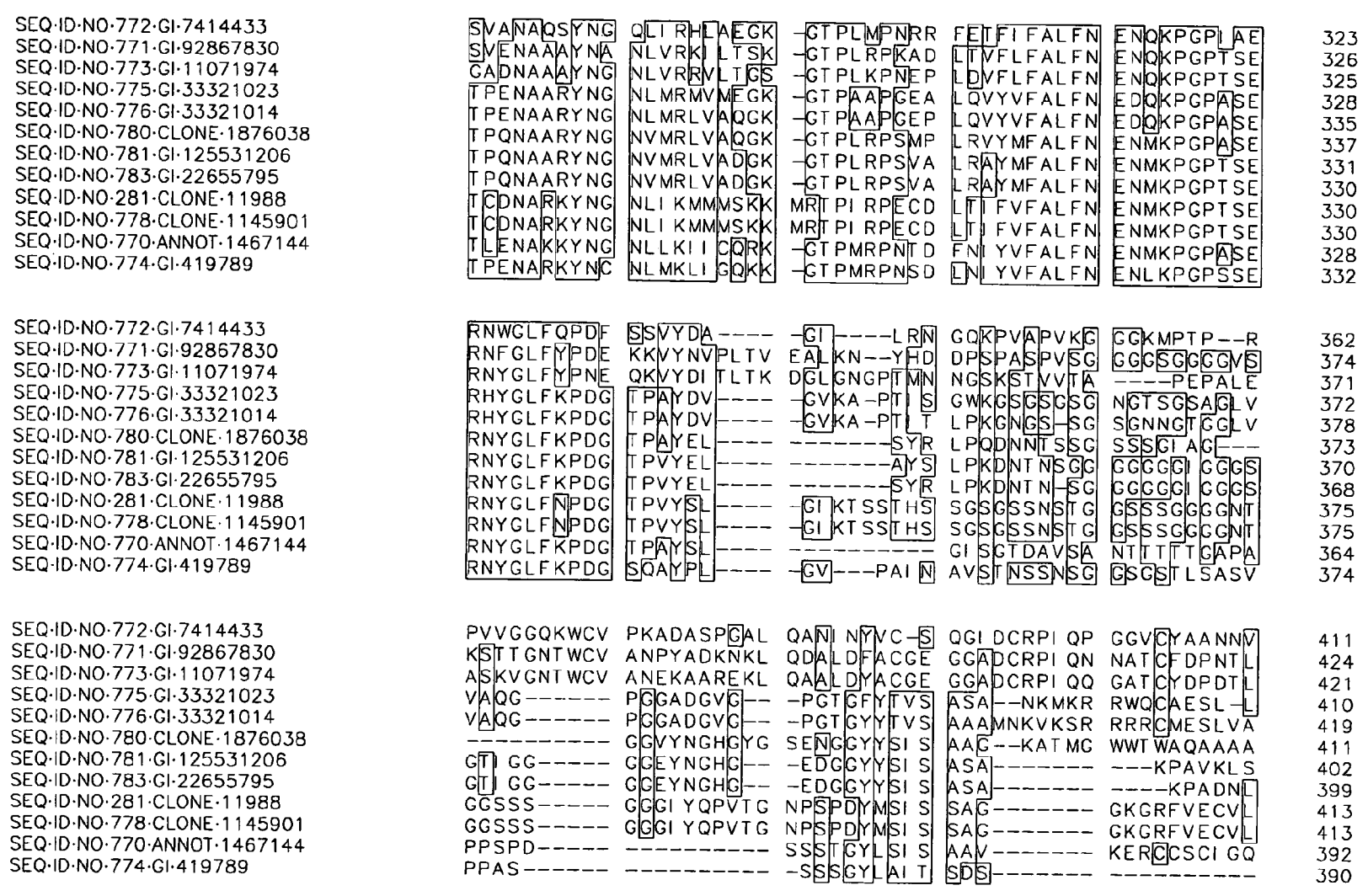

FIGS. 20A-20D are an alignment of the amino acid sequence of CeresClone 11988 (SEQ ID NO:281) with homologous and/or orthologous amino acid sequences Annot ID 1467144 (SEQ ID NO:770), gi|92867830 (SEQ ED NO:771), gi|7414433 (SEQ ID NO:772), gi|11071974 (SEQ ID NO:773), gi|419789 (SEQ ID NO:774), gi|33321023 (SEQ ID NO:775), gi|33321014 (SEQ ID NO:776), Ceres-Clone 1145901 (SEQ ID NO:778), CeresClone 1876038 (SEQ ID NO:780), gi|125531206 (SEQ ID NO:781), and gi|22655795 (SEQ ID NO:783).

Figure 21A:
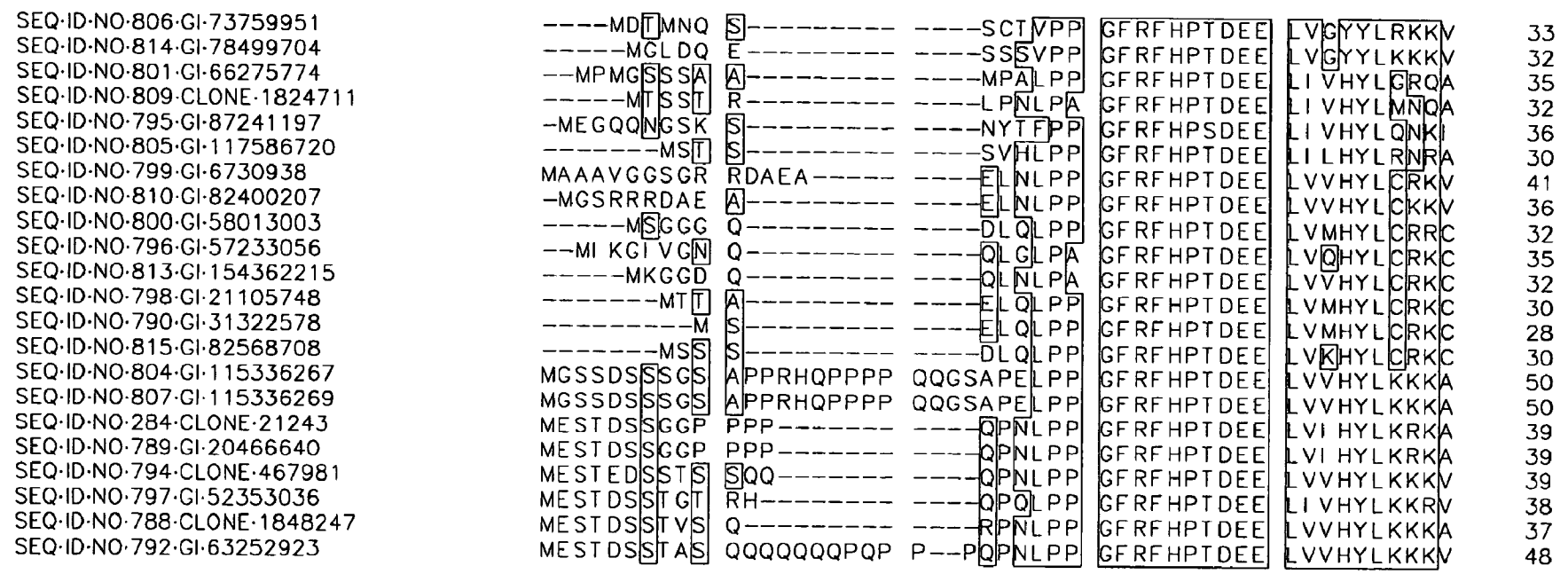
Figure 21C:
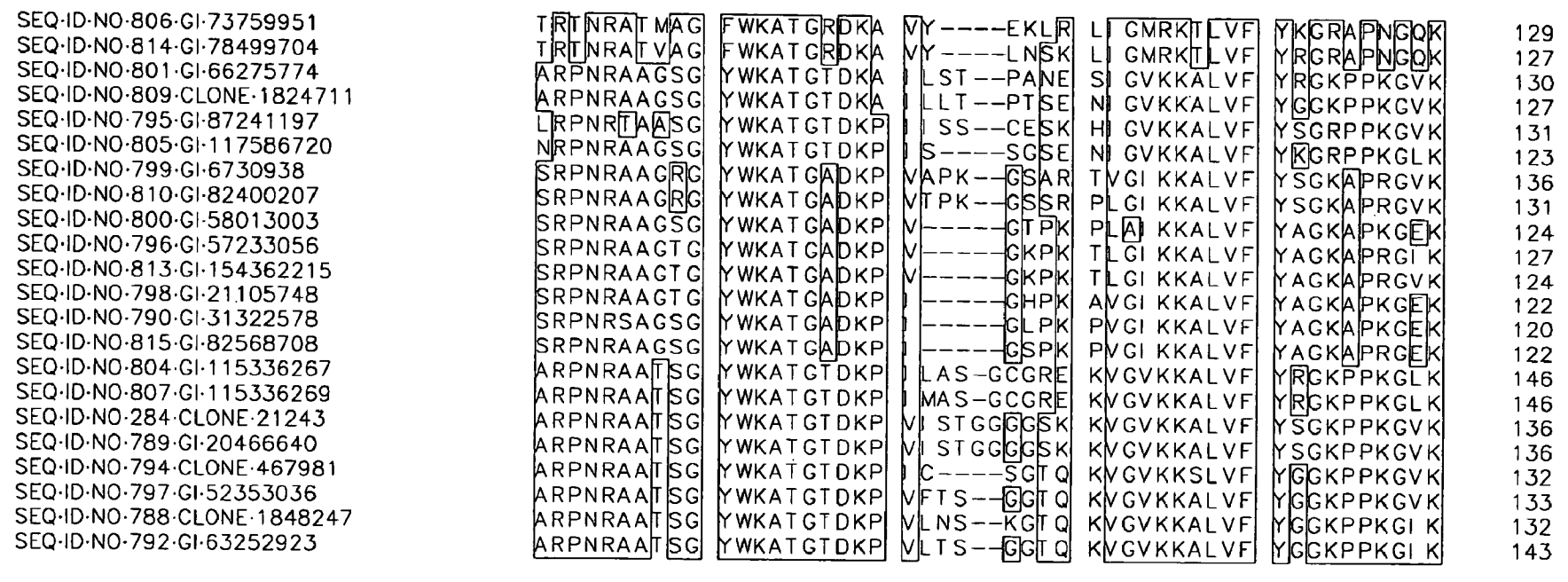
Figure 21D:
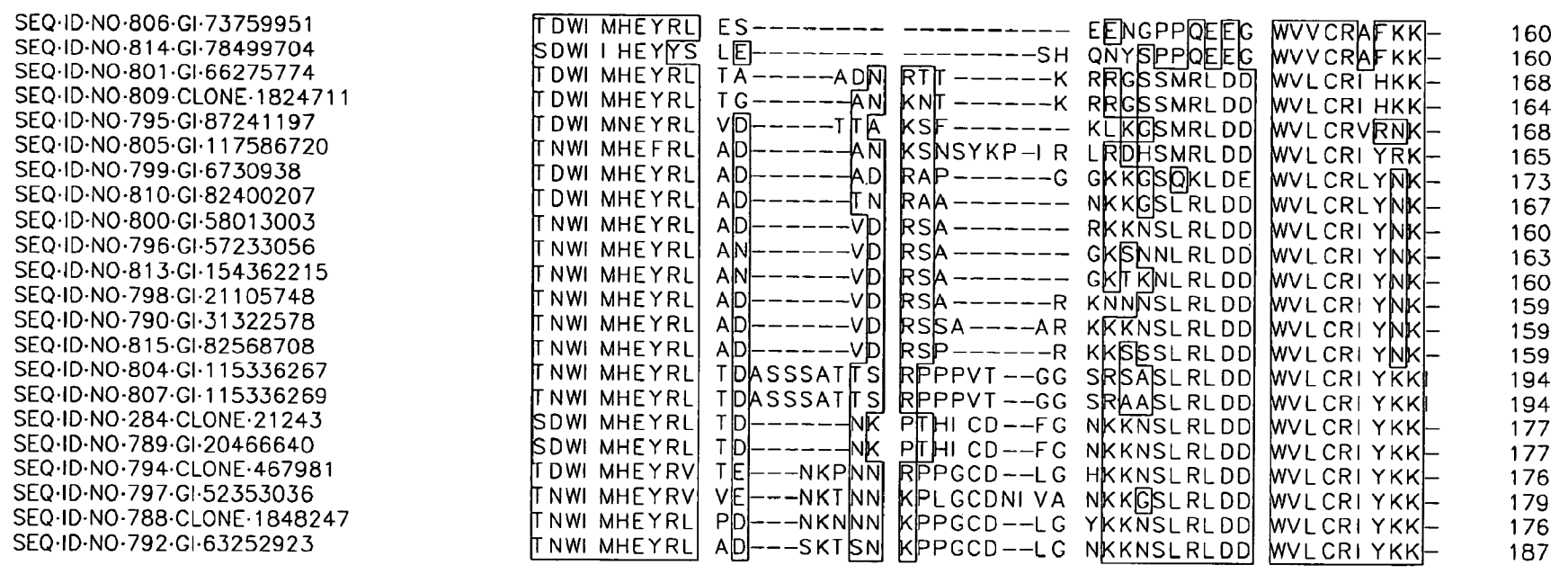
Figure 21G:
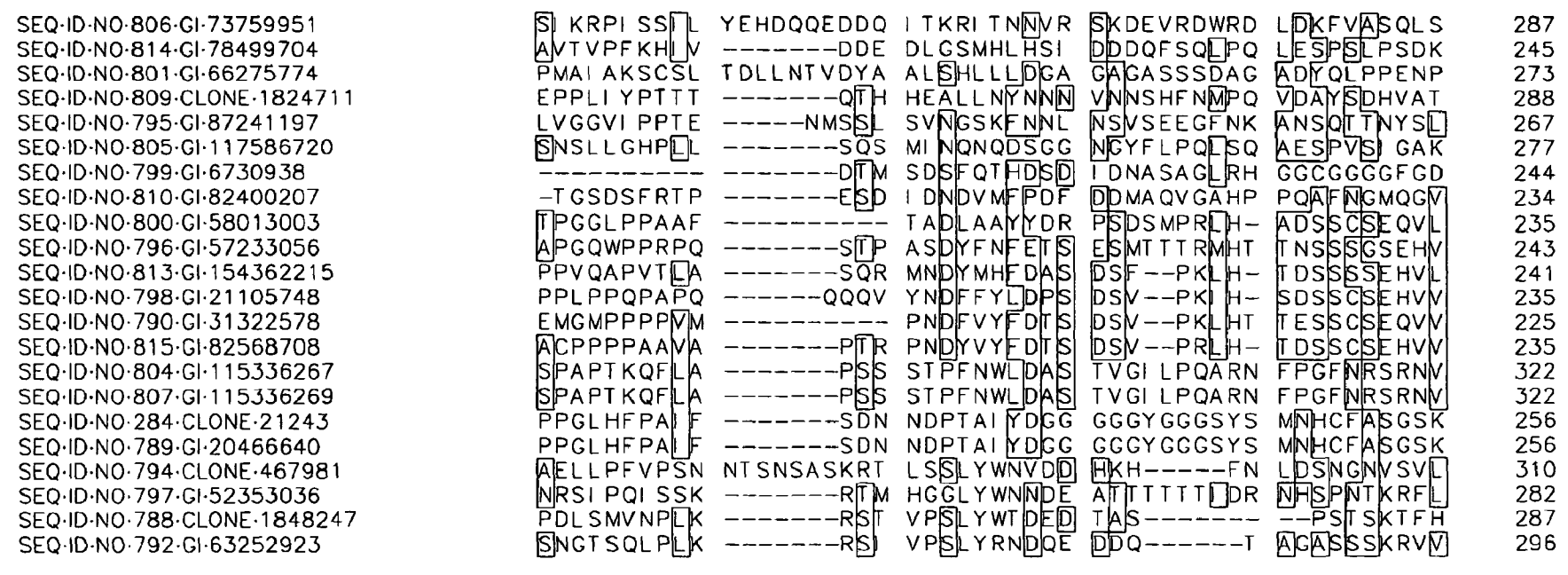
Figure 21H:
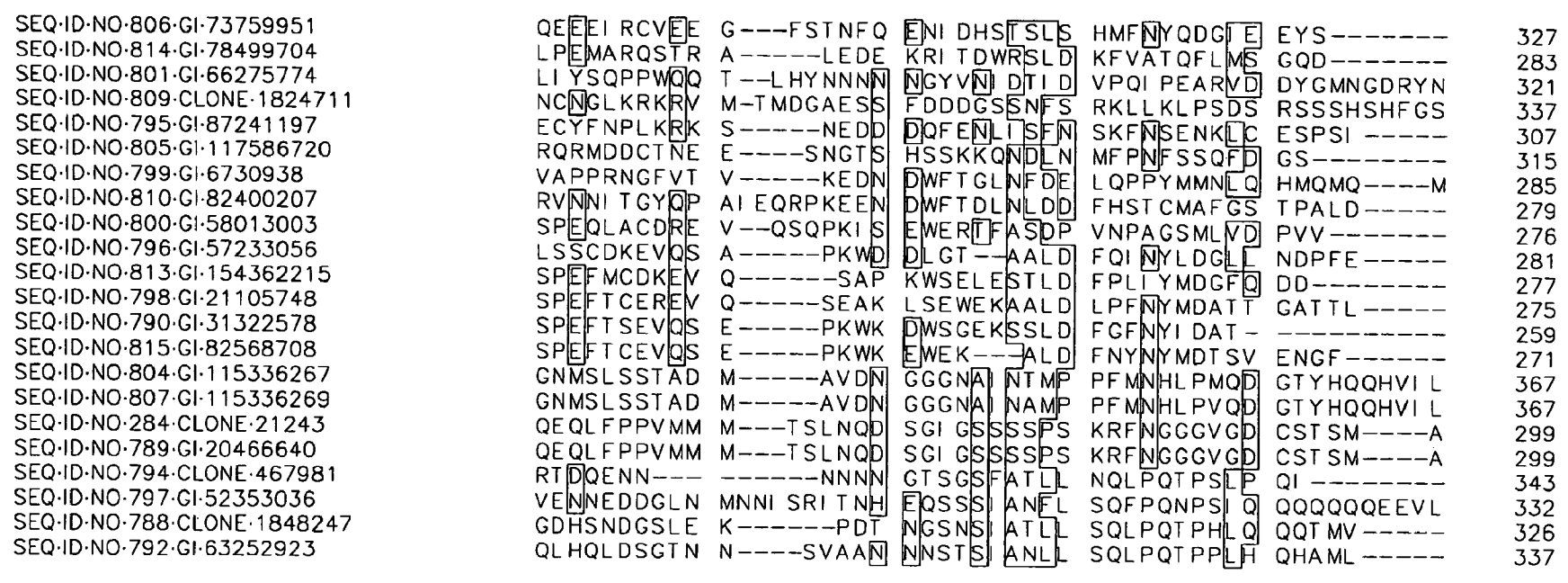

FIGS. 21A-21I are an alignment of the amino acid sequence of CeresClone 21243 (SEQ ID NO:284) with homologous and/or orthologous amino acid sequences CeresClone 1848247 (SEQ ID NO:788), gi|20466640 (SEQ ID NO:789), gi|31322578 (SEQ ID NO:790), gi|63252923 (SEQ ID NO:792), CeresClone 467981 (SEQ ID NO:794), gi|87241197 (SEQ ID NO:795), gi|57233056 (SEQ ID NO:796), gi|52353036 (SEQ ID NO:797), gi|21105748 (SEQ ID NO:798), gi|6730938 (SEQ ID NO:799), gi|58013003 (SEQ ID NO:800), gi|66275774 (SEQ ID NO:801), gi|115336267 (SEQ ID NO:804), gi|117586720 (SEQ ID NO:805), gi|73759951 (SEQ ID NO:806), gi|115336269 (SEQ ID NO:807), CeresClone 1824711 (SEQ ID NO:809), gi|82400207 (SEQ ID NO:810), gi|154362215 (SEQ ID NO:813), gi|78499704 (SEQ ID NO:814), and gi|82568708 (SEQ ID NO:815).

FIG. 22 is an alignment of the amino acid sequence of CeresClone 41046 (SEQ ID NO:289) with homologous and/or orthologous amino acid sequences gi|54634694 (SEQ ID NO:816) and gi|38322956 (SEQ ID NO:820).

DETAILED DESCRIPTION

Figure 4C:
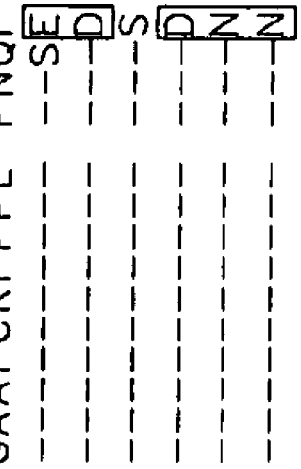

The invention features methods and materials related to modulating (e.g., decreasing) the lignin content in plants. The methods can include transforming a plant cell with a nucleic acid encoding a lignin-modulating polypeptide, wherein expression of the polypeptide results in a modulated (e.g., increased or decreased) lignin content. Plant cells produced using such methods can be grown to produce plants having a modulated lignin content. Such plants can have a modulated amount and/or rate of lignin biosynthesis. For example, the rate of biosynthesis of one or more lignin monomers, e.g., monolignols, can be modulated. In some cases, the rate of polymerization of lignin monomers into lignin can be modulated. In addition, the structure and/or composition of lignin produced by transgenic plants described herein can vary from that produced by corresponding wild-type plants.

Polypeptides

The term "polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. The term "amino acid" refers to natural and/or unnatural or synthetic amino acids, including D/L optical isomers. Full-length proteins, analogs, mutants, and fragments thereof are encompassed by this definition.

Polypeptides described herein include lignin-modulating polypeptides. A lignin-modulating polypeptide typically is effective for modulating lignin content when expressed in a plant or plant cell. Modulation of the lignin content can be an increase or decrease in the amount and/or rate of biosynthesis of lignin relative to the corresponding amount and/or rate in a control plant. The structure of lignin, its composition (e.g., proportion of p-hydroxyphenyl (H), guaiacyl (G), or syringyl (S) units), or both can also be modulated. In some cases, the rate of polymerization of lignin monomers (e.g., p-coumaryl, coniferyl, and sinapyl alcohols) into lignin is modulated.

A lignin-modulating polypeptide can have an NAD epimerase/dehydratase domain characteristic of a nicotinamide adenine dinucleotide (NAD)-dependent epimerase/dehydratase polypeptide. The NAD-dependent epimerase/dehydratase family of proteins utilize NAD as a cofactor and use nucleotide-sugar substrates for a variety of chemical reactions. SEQ ID NO:149 and SEQ ID NO:160 set forth the amino acid sequences of DNA clones, identified herein as Ceres ANNOT ID no. 860791 (SEQ ID NO:148) and Ceres ANNOT ID no. 863641 (SEQ ID NO:159), respectively, each of which is predicted to encode a polypeptide containing an NAD_binding_4 domain.

A lignin-modulating polypeptide can comprise the amino acid sequence set forth in SEQ ID NO:149 or SEQ ID NO:160. In some cases, a lignin-modulating polypeptide can be a homolog, ortholog, or variant of the polypeptide having the amino acid sequence set forth in SEQ ID NO:149 or SEQ ID NO:160. For example, a lignin-modulating polypeptide can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99%, sequence identity, to the amino acid sequence set forth in SEQ ID NO:149 or SEQ ID NO:160.

Amino acid sequences of homologs and/or orthologs of the polypeptide having the amino acid sequence set forth in SEQ ID NO:149 and SEQ ID NO:160 are provided in FIGS. 4A-4C and FIGS. 5A-5B, respectively. For example, the alignment in FIGS. 4A-4C provides the amino acid sequences of Annot ID 860791 (SEQ ID NO:149), CeresClone:477792 (SEQ ID NO:153), CeresClone:677424 (SEQ ID NO:154), gi|51091033 (SEQ ID NO:155), CeresClone:336720 (SEQ ID NO:156), CeresClone:1790816 (SEQ ID NO:158), and Ceres Clone:1930079 (SEQ ID NO:319). Other homologs and/or orthologs of SEQ ID NO:149 include Public GI no. 15226135 (SEQ ID NO:150) and CeresClone 1930079 (SEQ ID NO:152).

The alignment in FIGS. 5A-5B provides the amino acid sequences of Locus At1g08200 (Ceres ANNOT ID no. 863641; SEQ ID NO:160), CeresClone:1459647 (SEQ ID NO:162), CeresGdna:1541782 (SEQ ID NO:165), gi|85718018 (SEQ ID NO:168), gi|37379419 (SEQ ID NO:169), gi|34905954 (SEQ ID NO:171), and gi|92894433 (SEQ ID NO:172). Other homologs and/or orthologs of SEQ ID NO:160 include Public GI no. 14596185 (SEQ ID NO:161), Public GI no. 60547725 (SEQ ID NO:163), Ceres ANNOT ID no. 1460446 (SEQ ID NO:167), Ceres CLONE ID no. 300029 (SEQ ID NO:170), Public GI no. 42602317 (SEQ ID NO:173), and Ceres CLONE ID no. 243057 (SEQ ID NO:174).

In some cases, a lignin-modulating polypeptide can include a polypeptide having at least 80% sequence identity, e.g., 80%, 85%, 90%, 93%, 95%, 97%, 98%, or 99% sequence identity, to an amino acid sequence corresponding to any of SEQ ID NO:150, SEQ ID NOs:152-156, SEQ ID NO:158, SEQ ID NOs:161-163, SEQ ID NO:165, SEQ ID NOs:167-174, and SEQ ID NO:319.

A lignin-modulating polypeptide can have a XET_C domain and a Glyco_hydro_16 domain. The XET_C domain is characteristic of the C-terminus (about 60 amino acid residues) of a plant xyloglucan endo-transglycosylase (XET) polypeptide. Xyloglucan is the predominant hemicellulose in the cell walls of most dicotyledons. Xyloglucan forms a network with cellulose that strengthens the cell wall. XET catalyzes the splitting of xyloglucan chains and the linking of the newly generated reducing end to the non-reducing end of another xyloglucan chain, thereby loosening the cell wall. Polypeptides belonging to the XET_C polypeptide family also contain the Glyco_hydro_16 domain characteristic of glycosyl hydrolase family 16 polypeptides. O-glycosyl hydrolases (EC 3.2.1.-) hydrolyze the glycosidic bond between two or more carbohydrates, or between a carbohydrate and a non-carbohydrate moiety. A classification system for glycosyl hydrolases, based on sequence similarity, has led to the definition of 85 different families. Since the folds of the polypeptides are better conserved than the sequences, some of the families can be grouped in "clans." Glycoside hydrolase family 16 comprises enzymes with a number of known activities, including lichenase, xyloglucan xyloglucosyltransferase, agarase, kappa-carrageenase, endo-beta-1,3-glucanase, endo-beta-1,3-1,4-glucanase, and endo-beta-galactosidase. SEQ ID NO:204 sets forth the amino acid sequence of a DNA clone, identified herein as Ceres ANNOT ID no. 887718 (SEQ ID NO:203), that is predicted to encode a polypeptide containing a XET_C domain and a Glyco_hydro_16 domain.

A lignin-modulating polypeptide can comprise the amino acid sequence set forth in SEQ ID NO:204. In some cases, a lignin-modulating polypeptide can be a homolog, ortholog, or variant of the polypeptide having the amino acid sequence set forth in SEQ ID NO:204. For example, a lignin-modulating polypeptide can have an amino acid sequence with at least 65% sequence identity, e.g., 67%, 68%, 70%, 75%, 80%, 85%, 90%, 95%, 97%, 98%, or 99% sequence identity, to the amino acid sequence set forth in SEQ ID NO:204.

Figure 9A:
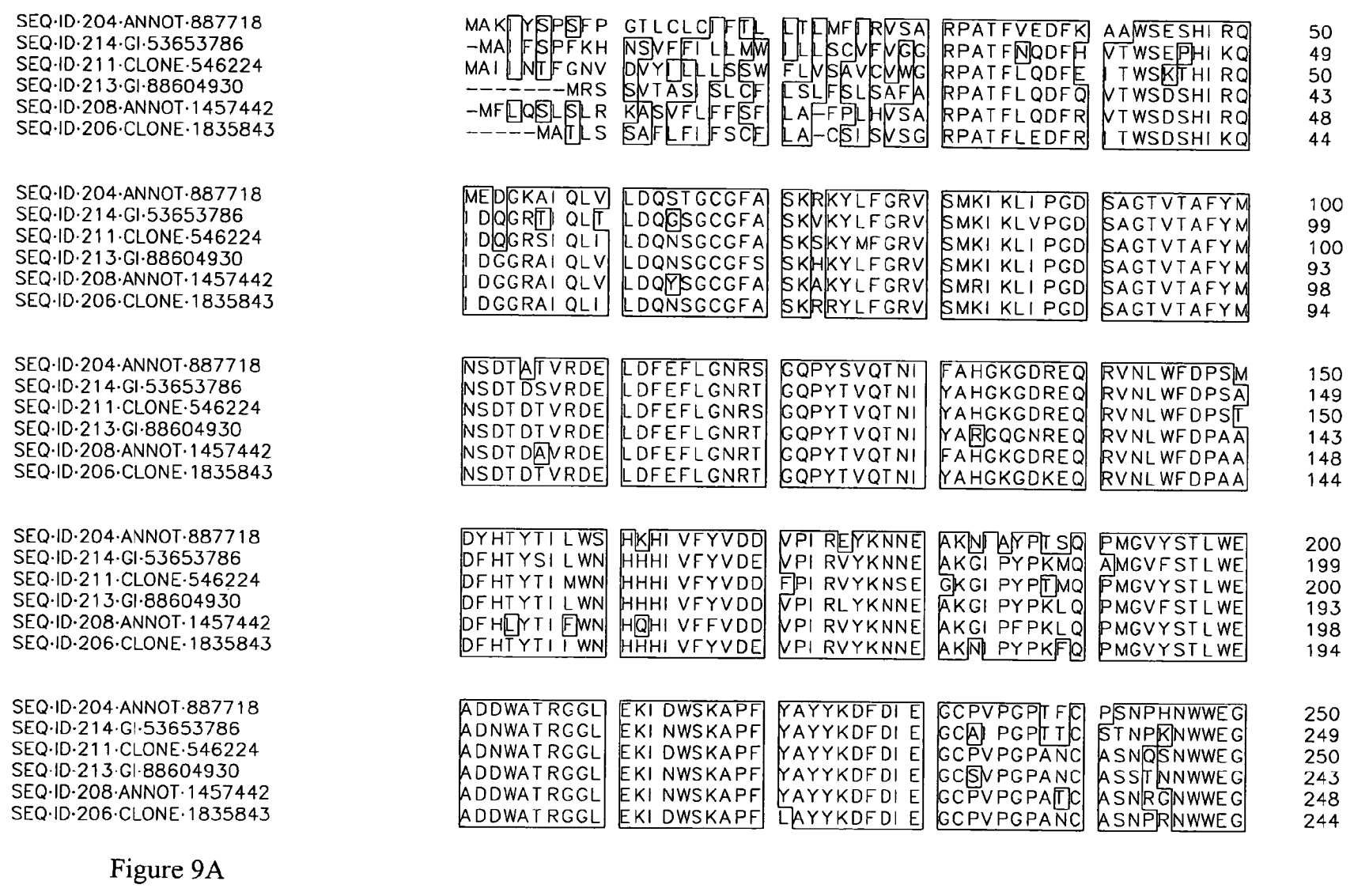

Amino acid sequences of homologs and/or orthologs of the polypeptide having the amino acid sequence set forth in SEQ ID NO:204 are provided in FIGS. 9A-9B. For example, the alignment in FIGS. 9A-9B provides the amino acid sequences of Annot ID 887718 (SEQ ID NO:204), CeresClone:1835843 (SEQ ID NO:206), CeresAnnot:1457442 (SEQ ID NO:208), CeresClone:546224 (SEQ ID NO:211), gi|88604930 (SEQ ID NO:213), and gi|53653786 (SEQ ID NO:214). Other homologs and/or orthologs of SEQ ID NO:204 include Ceres CLONE ID no. 1836342 (SEQ ID NO:210), and Ceres CLONE ID no. 142634 (SEQ ID NO:212).

In some cases, a lignin-modulating polypeptide can include a polypeptide having at least 80% sequence identity, e.g., 80%, 85%, 90%, 93%, 95%, 97%, 98%, or 99% sequence identity, to an amino acid sequence corresponding to any of SEQ ID NO:206, SEQ ID NO:208, SEQ ID NOs: 210-214.

A lignin-modulating polypeptide can have a Glyco_hydro_9 domain characteristic of a glycosyl hydrolase family 9 polypeptide. Glycoside hydrolase family 9 comprises enzymes with several known activities, including endoglucanase and cellobiohydrolase. Glycosyl hydrolase family 9 was formerly known as cellulase family E. SEQ ID NO:136 sets forth the amino acid sequence of a DNA clone, identified herein as Ceres ANNOT ID no. 860676 (SEQ ID NO:135), that is predicted to encode a polypeptide containing a Glyco_hydro_9 domain.

In some cases, a lignin modulating polypeptide can have a Glyco_hydro_17 domain characteristic of a glycosyl hydrolase family 17 polypeptide. Glycoside hydrolase family 17 comprises enzymes with several known activities, including endo-1,3-beta-glucosidase, lichenase, and exo-1,3-glucanase. These enzymes have been found in plants and fungi. SEQ ID NO:281 sets forth the amino acid sequence of a DNA clone, identified herein as Ceres CLONE ID no. 11988 (SEQ ID NO:280), that is predicted to encode a polypeptide containing a Glyco_hydro_17 domain.

A lignin-modulating polypeptide can comprise the amino acid sequence set forth in SEQ ID NO:136 or SEQ ID NO:281. In some cases, a lignin-modulating polypeptide can be a homolog, ortholog, or variant of the polypeptide having the amino acid sequence set forth in SEQ ID NO:136 or SEQ ID NO:281. For example, a lignin-modulating polypeptide can have an amino acid sequence with at least 60% sequence identity, e.g., 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:136 or SEQ ID NO:281.

Figure 3A:
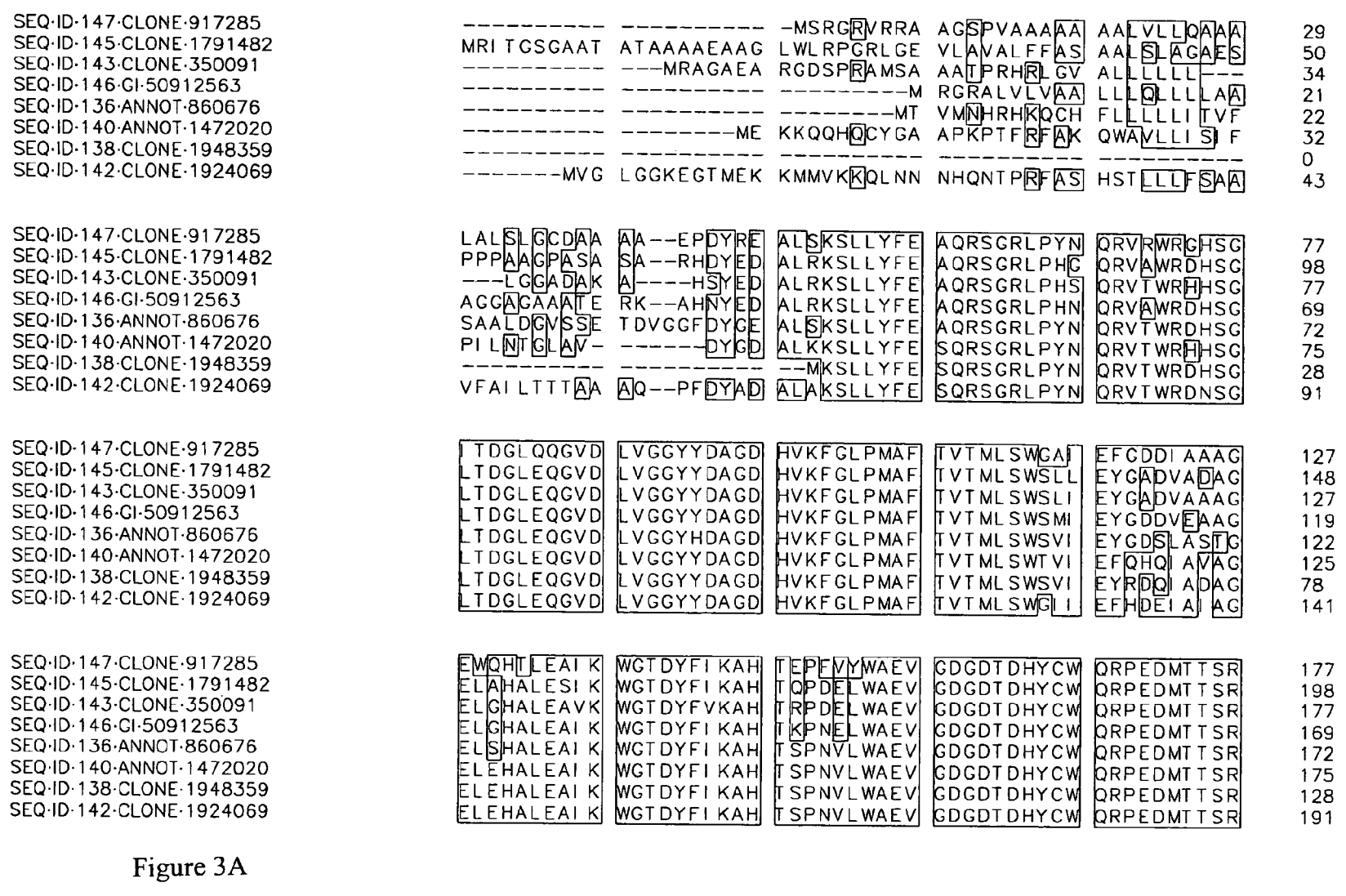
Figure 3B:
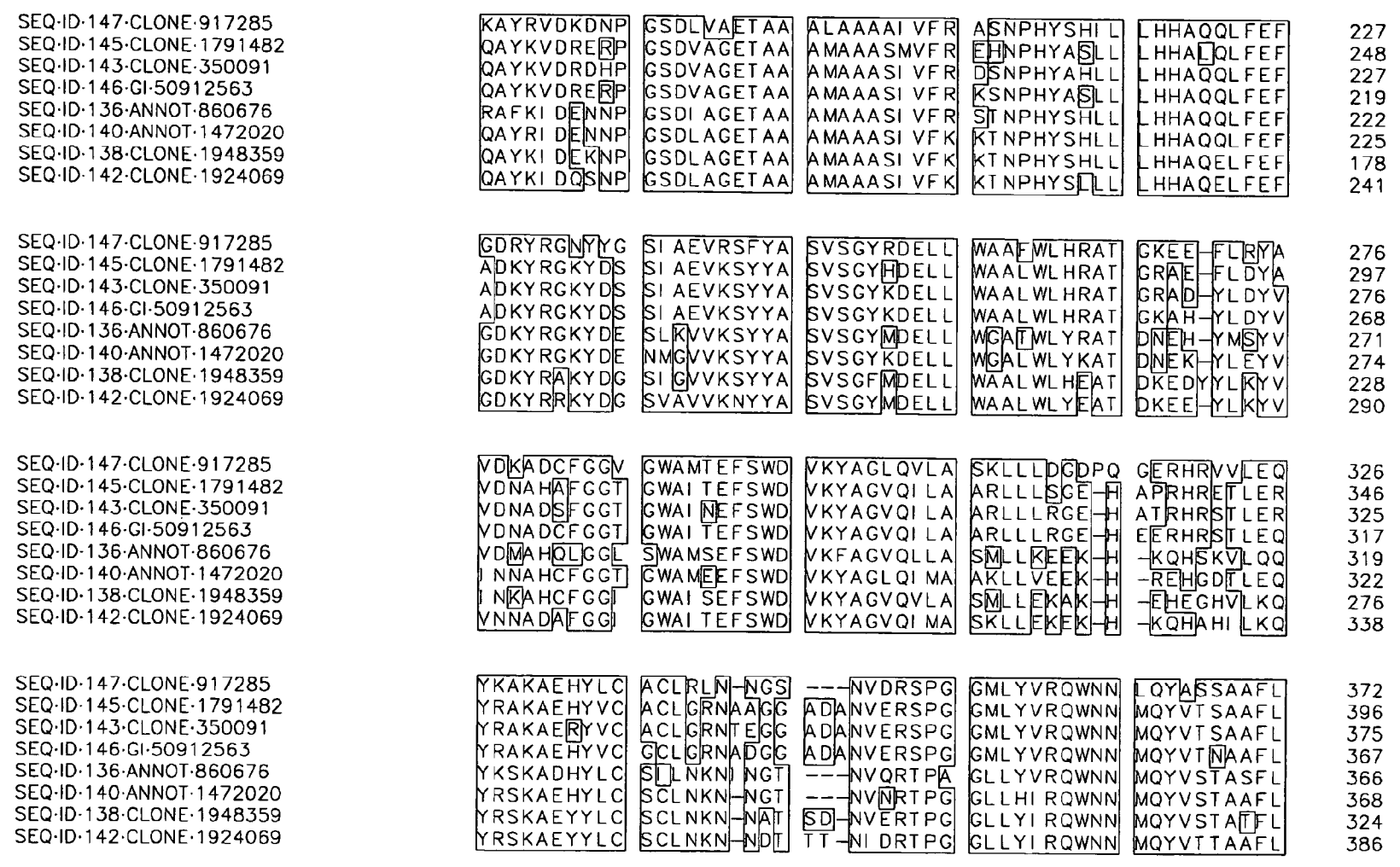

Amino acid sequences of homologs and/or orthologs of the polypeptide having the amino acid sequence set forth in SEQ ID NO:136 are provided in FIGS. 3A-3C. For example, the alignment in FIGS. 3A-3C provides the amino acid sequences of Annot ID 860676 (SEQ ID NO:136), CeresClone:1948359 (SEQ ID NO:138), CeresAnnot:1472020 (SEQ ID NO:140), CeresClone:1924069 (SEQ ID NO:142), CeresClone: 350091 (SEQ ID NO:143), CeresClone:1791482 (SEQ ID NO:145), gi|50912563 (SEQ ID NO:146), and CeresClone: 917285 (SEQ ID NO:147).

Amino acid sequences of homologs and/or orthologs of the polypeptide having the amino acid sequence set forth in SEQ ID NO:281 are provided in FIGS. 20A-20D. For example, the alignment in FIGS. 20A-20D provides the amino acid sequences of CeresClone 11988 (SEQ ID NO:281), Annot ID 1467144 (SEQ ID NO:770), gi|92867830 (SEQ ID NO:771), gi|7414433 (SEQ ID NO:772), gi|11071974 (SEQ ID NO:773), gi|419789 (SEQ ID NO:774), gi|33321023 (SEQ ID NO:775), gi|33321014 (SEQ ID NO:776), CeresClone 1145901 (SEQ ID NO:778), CeresClone 1876038 (SEQ ID NO:780), gi|125531206 (SEQ ID NO:781), and gi|22655795 (SEQ ID NO:783). Other homologs and/or orthologs of SEQ ID NO:281 include Annot ID 1441963 (SEQ ID NO:768), gi|125561574 (SEQ ID NO:782) gi|115481224 (SEQ ID NO:784), gi|115451885 (SEQ ID NO:785), and gi|125585592 (SEQ ID NO:786).

In some cases, a lignin-modulating polypeptide can include a polypeptide having at least 80% sequence identity, e.g., 80%, 85%, 90%, 93%, 95%, 97%, 98%, or 99% sequence identity, to an amino acid sequence corresponding to any of SEQ ID NO:138, SEQ ID NO:140, SEQ ID NOs: 142-143, SEQ ID NOs:145-147, SEQ ID NO:768, SEQ ID NOs:770-776, SEQ ID NO:778, or SEQ ID NOs:780-786.

A lignin-modulating polypeptide can have a Dimerisation domain and a Methyltransf_2 domain characteristic of O-methyltransferase polypeptides. The Dimerisation domain is found at the N-terminus of a variety of plant O-methyltransferase polypeptides and has been shown to mediate dimerization of these polypeptides. O-methyltransferase polypeptides transfer methyl groups, e.g., from S-adenosyl methionine, to nitrogen, oxygen, or carbon atoms. For example, O-methyltransferases modify DNA, RNA, polypeptides, and small molecules such as catechol for regulatory purposes. In prokaryotes, the major role of DNA methylation is to protect host DNA against degradation by restriction enzymes. In eukaryotes, DNA methylation has been implicated in the control of several cellular processes, including differentiation, gene regulation, and embryonic development. O-methyltransferases have a common catalytic domain structure, which may be universal among S-adenosyl methionine-dependent methyltransferases. SEQ ID NO:190, SEQ ID NO:192, and SEQ ID NO:344 set forth the amino acid sequences of DNA clones, identified herein as Ceres ANNOT ID no. 869790 (SEQ ID NO:189), Ceres ANNOT ID no. 869854 (SEQ ID NO:191), and Ceres LOCUS ID no. 1520476 (SEQ ID NO:343), respectively, each of which is predicted to encode a polypeptide containing a Dimerisation domain and a Methyltransf_2 domain.

In some cases, a lignin-modulating polypeptide can have a Methyltransf_3 domain characteristic of O-methyltransferase polypeptides. The Methyltransf_3 family includes catechol O-methyltransferase, caffeoyl-CoA O-methyltransferase, and a family of bacterial O-methyltransferases that may be involved in antibiotic production. SEQ ID NO:291 sets forth the amino acid sequence of a DNA clone, identified herein as Ceres CLONE ID no. 8049 (SEQ ID NO:290), that is predicted to encode a polypeptide containing a Methyltransf_3 domain.

A lignin-modulating polypeptide can comprise the amino acid sequence set forth in SEQ ID NO:190, SEQ ID NO:192, SEQ ID NO:344, or SEQ ID NO:291. In some cases, a lignin-modulating polypeptide can be a homolog, ortholog, or variant of the polypeptide having the amino acid sequence set forth in SEQ ID NO:190, SEQ ID NO:192, SEQ ID NO:344, or SEQ ID NO:291. For example, a lignin-modulating polypeptide can have an amino acid sequence with at least 30% sequence identity, e.g., 31%, 35%, 40%, 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99%, sequence identity, to the amino acid sequence set forth in SEQ ID NO:190, SEQ ID NO:192, SEQ ID NO:344, or SEQ ID NO:291.

Figure 16A:
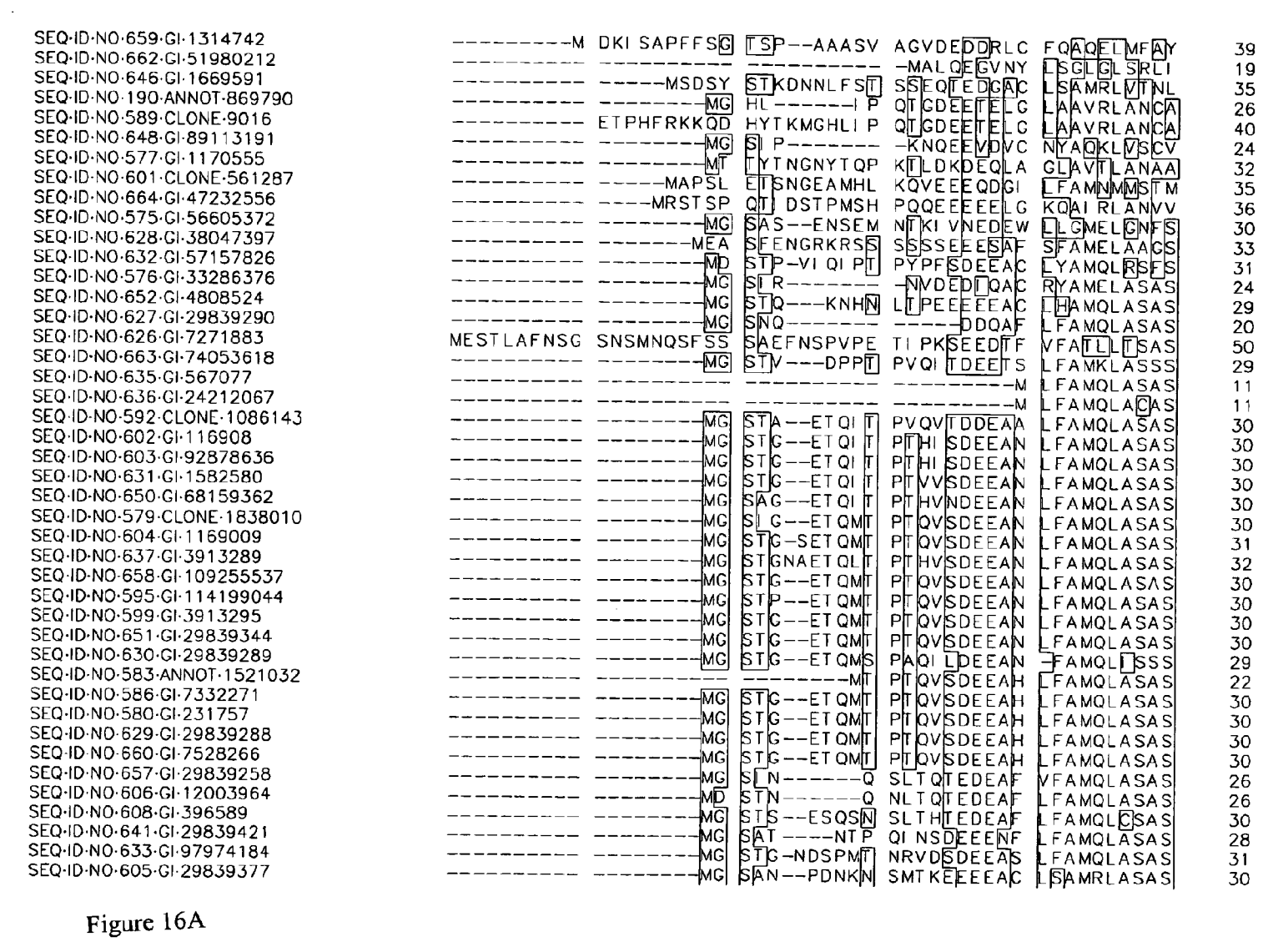
Figure 16B:
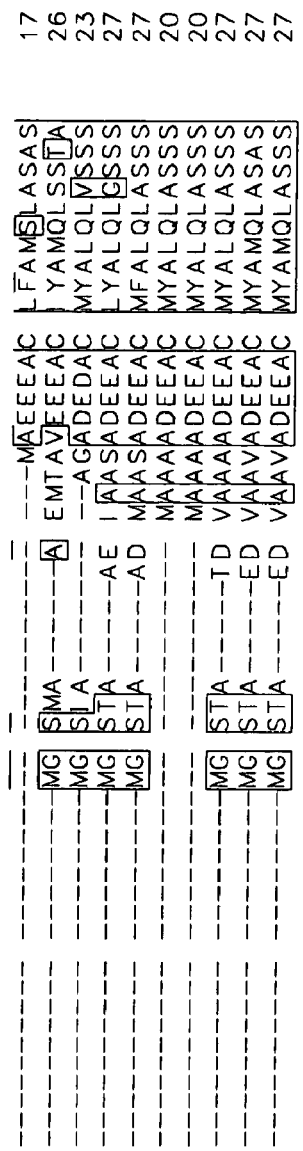
FIGS. 16A-16R are an alignment of the amino acid sequence of Annot ID 869790 (SEQ ID NO:190) with homologous and/or orthologous amino acid sequences gi|56605372 (SEQ ID NO:575), gi|33286376 (SEQ ID NO:576), gi|1170555 (SEQ ID NO:577), CeresClone 1838010 (SEQ ID NO:579), gi|231757 (SEQ ID NO:580), Annot ID 1521032 (SEQ ID NO:583), gi|7332271 (SEQ ID NO:586), CeresClone 9016 (SEQ ID NO:589), CeresClone 1086143 (SEQ ID NO:592), gi|114199044 (SEQ ID NO:595), gi|3913295 (SEQ ID NO:599), CeresClone 561287 (SEQ ID NO:601), gi|116908 (SEQ ID NO:602), gi|92878636 (SEQ ID NO:603), gi|1169009 (SEQ ID NO:604), gi|29839377 (SEQ ID NO:605), gi|12003964 (SEQ ID NO:606), gi|396589 (SEQ ID NO:608), gi|4104224 (SEQ ID NO:610), gi|29839259 (SEQ ID NO:613), gi|18033964 (SEQ ID NO:614), gi|77818928 (SEQ ID NO:616), CeresClone 1064285 (SEQ ID NO:621), gi|14578615 (SEQ ID NO:622), gi|7271883 (SEQ ID NO:626), gi|29839290 (SEQ ID NO:627), gi|38047397 (SEQ ID NO:628), gi|29839288 (SEQ ID NO:629), gi|29839289 (SEQ ID NO:630), gi|1582580 (SEQ ID NO:631), gi|57157826 (SEQ ID NO:632), gi|97974184 (SEQ ID NO:633), gi|567077 (SEQ ID NO:635), gi|24212067 (SEQ ID NO:636), gi|3913289 (SEQ ID NO:637), CeresClone 1869486 (SEQ ID NO:640), gi|29839421 (SEQ ID NO:641), gi|125560205 (SEQ ID NO:643), gi|125602246 (SEQ ID NO:644), gi|1669591 (SEQ ID NO:646), gi|22652500 (SEQ ID NO:647), gi|89113191 (SEQ ID NO:648), gi|68159362 (SEQ ID NO:650), gi|29839344 (SEQ ID NO:651), gi|4808524 (SEQ ID NO:652), gi|29839258 (SEQ ID NO:657), gi|109255537 (SEQ ID NO:658), gi|1314742 (SEQ ID NO:659), gi|7528266 (SEQ ID NO:660), gi|51980212 (SEQ ID NO:662), gi|74053618 (SEQ ID NO:663), and gi|47232556 (SEQ ID NO:664).
Figure 16C:
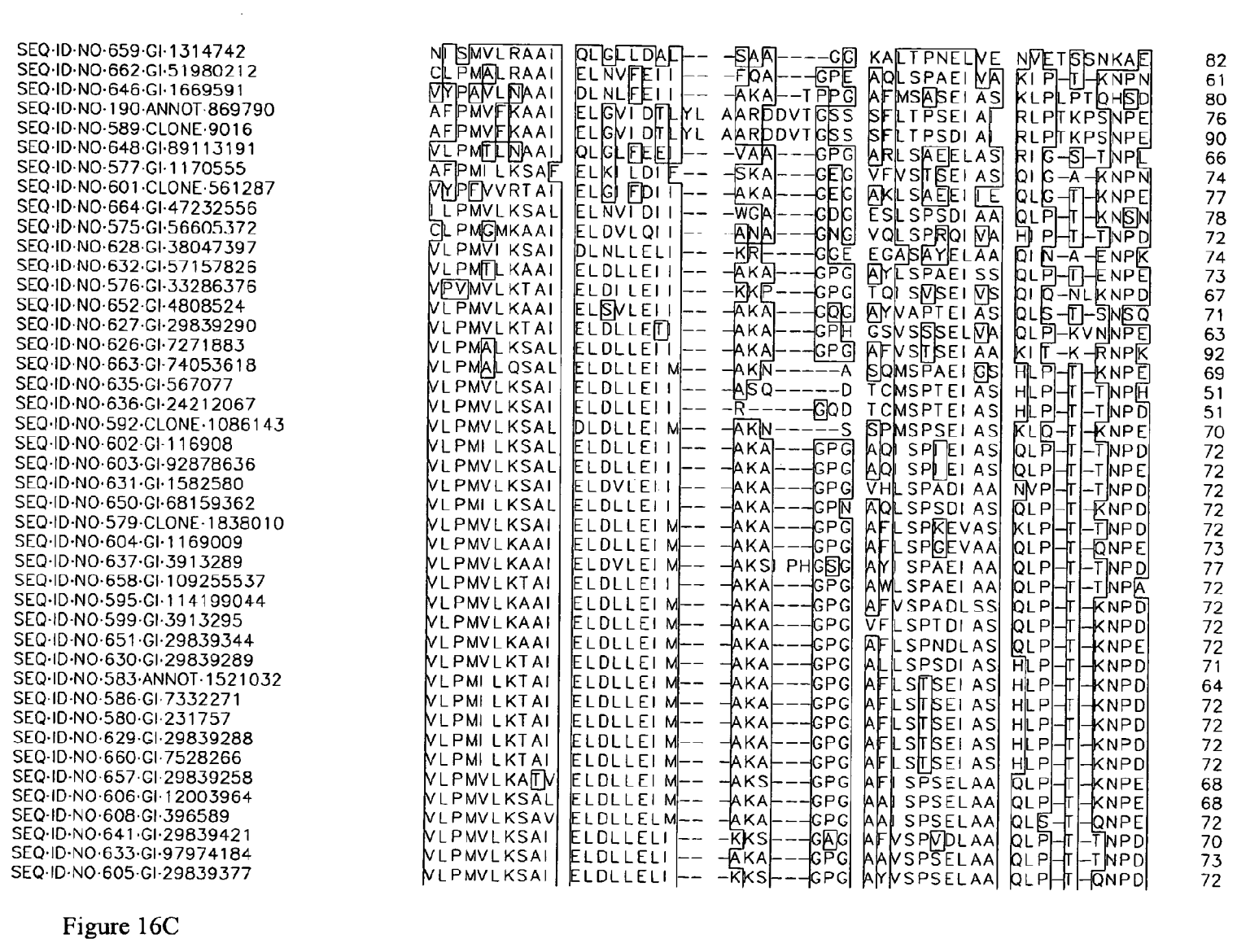
Figure 16D:
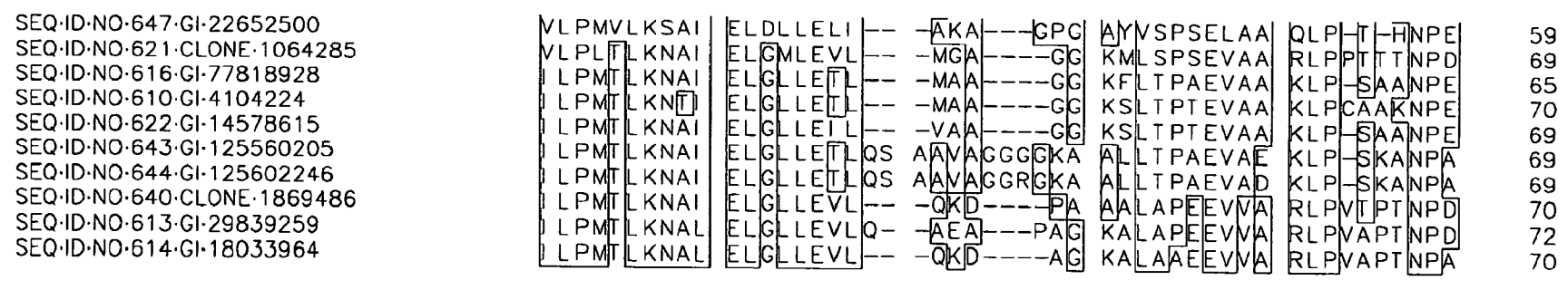
Figure 16E:
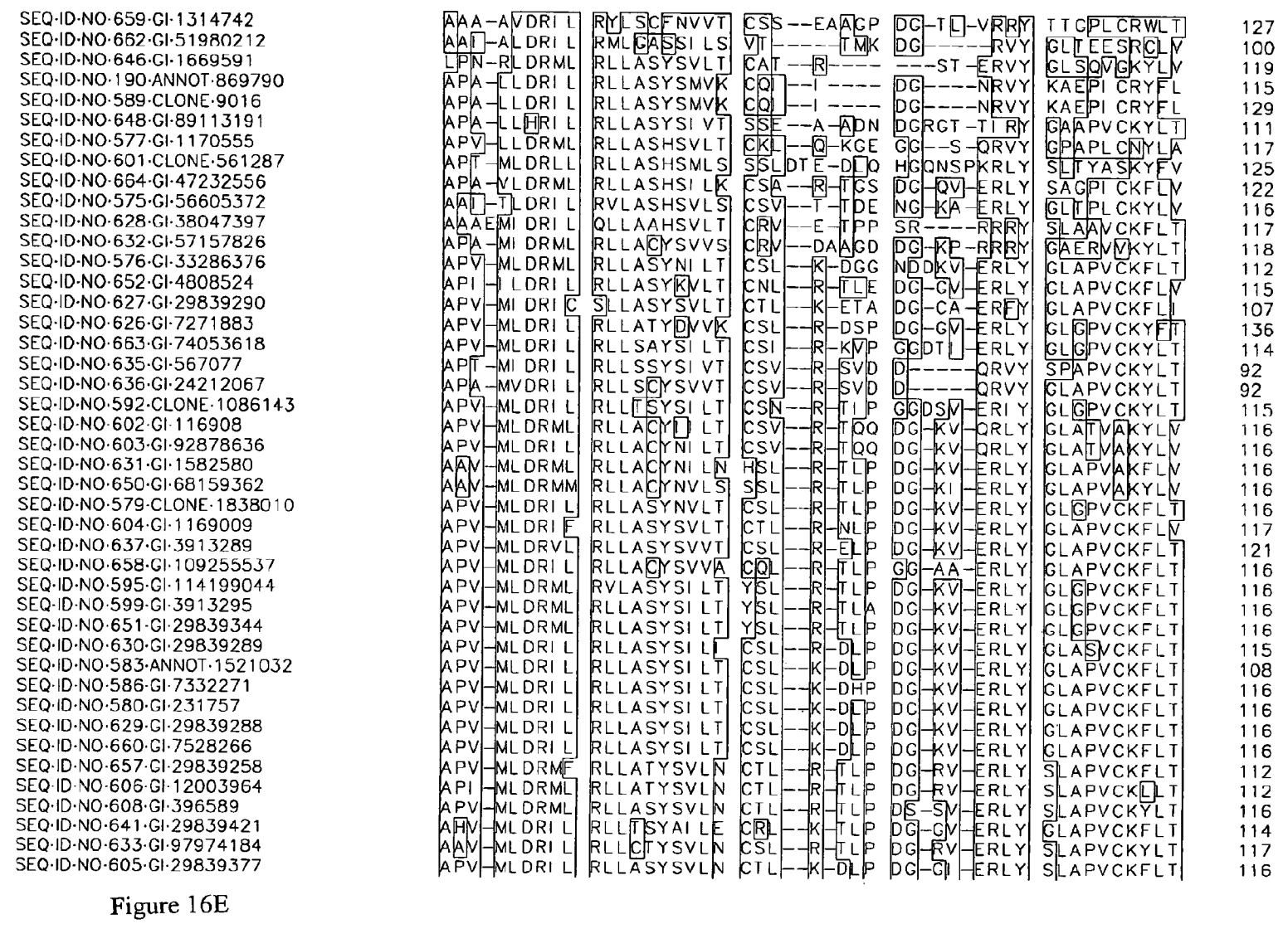
Figure 16G:
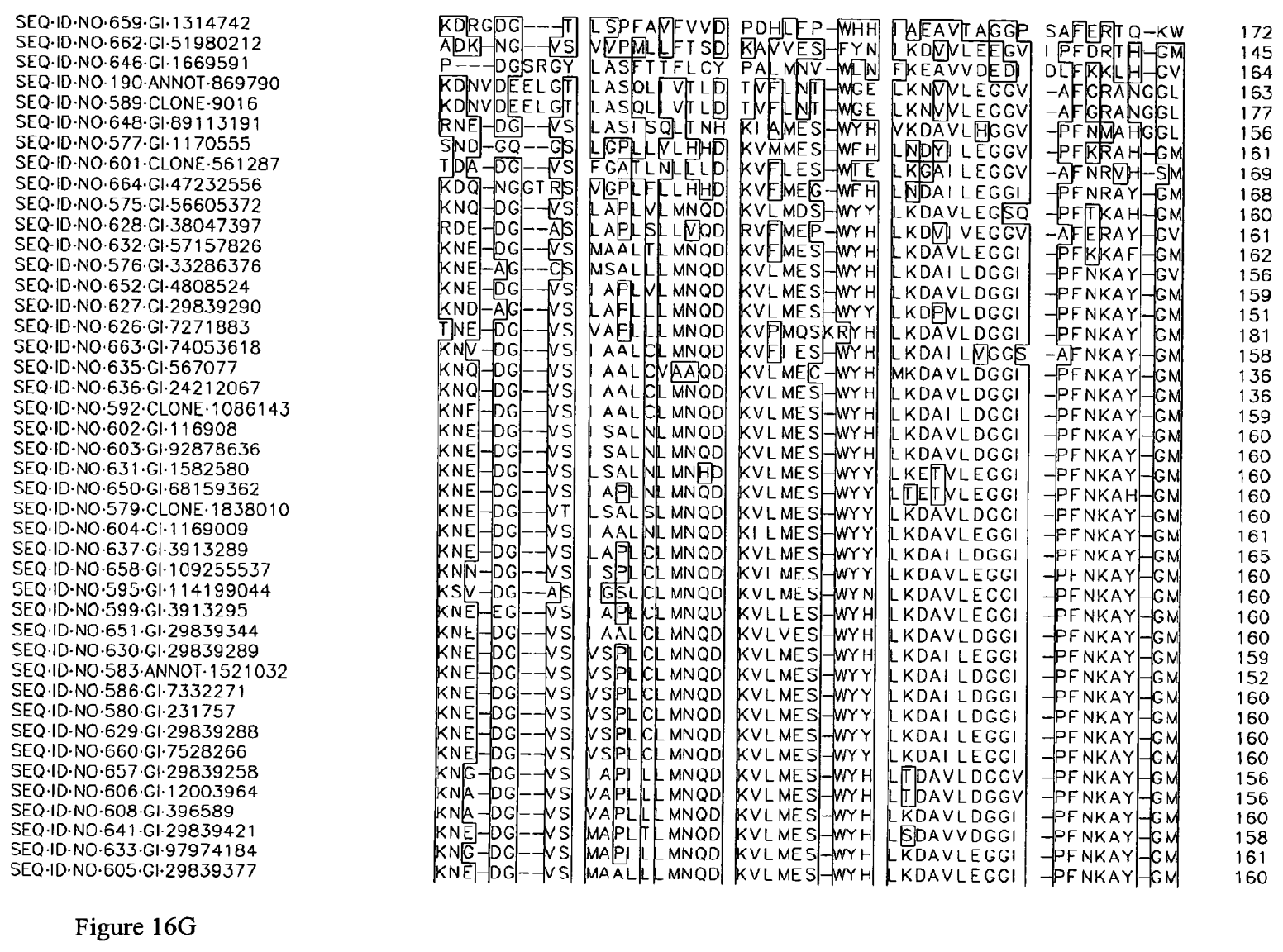
Figure 16I:
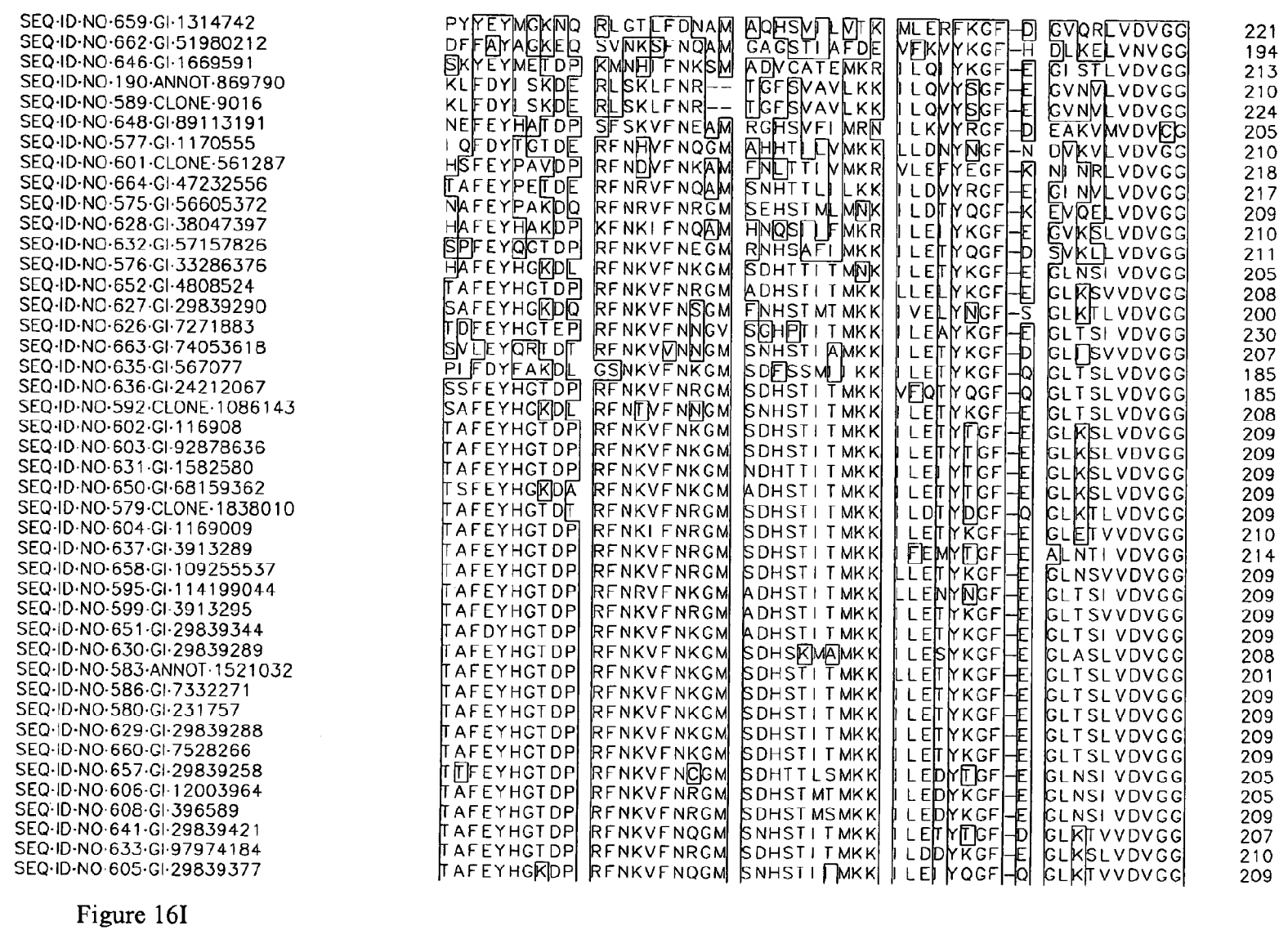
Figure 16K:
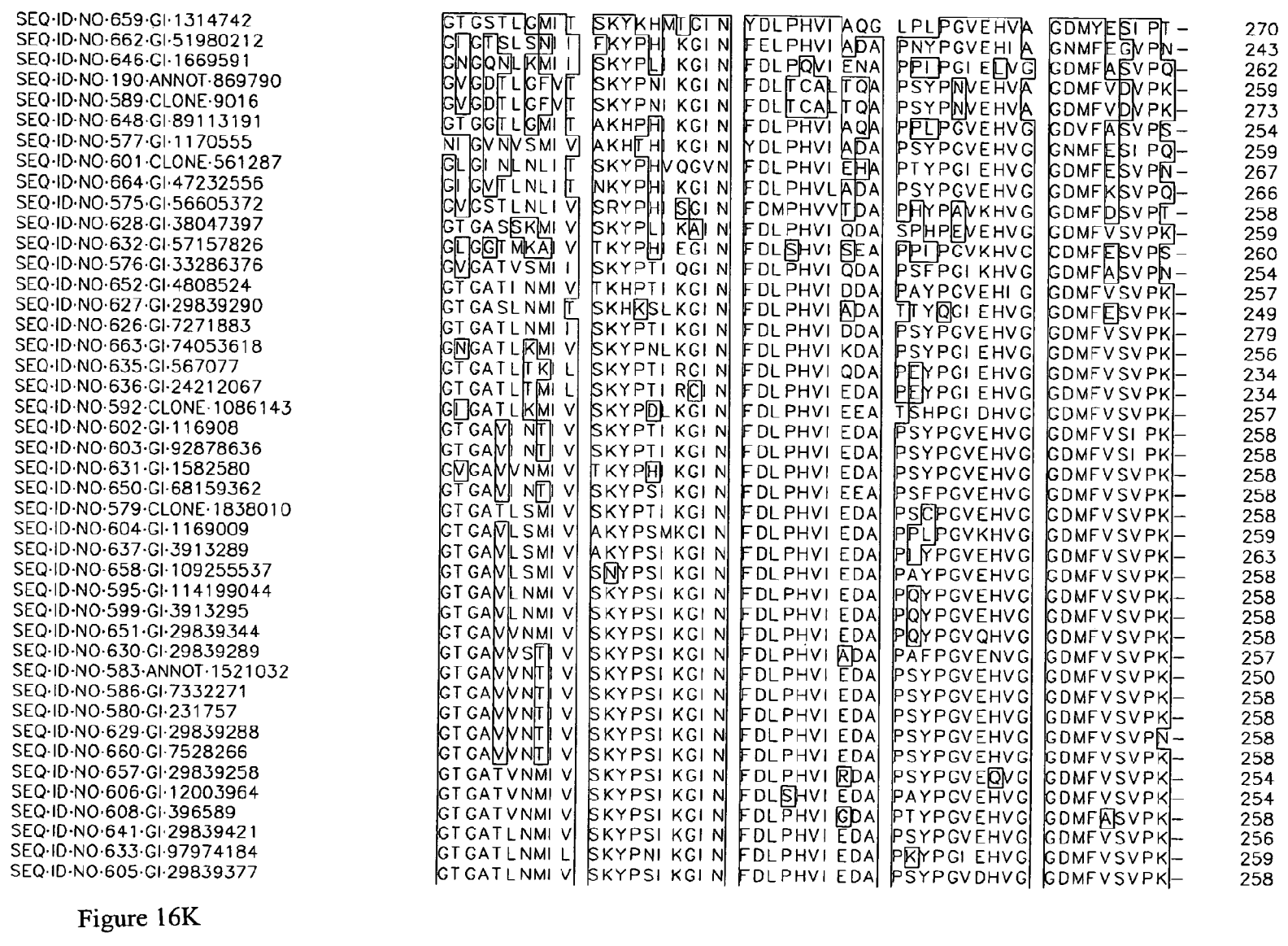
Figure 16M:
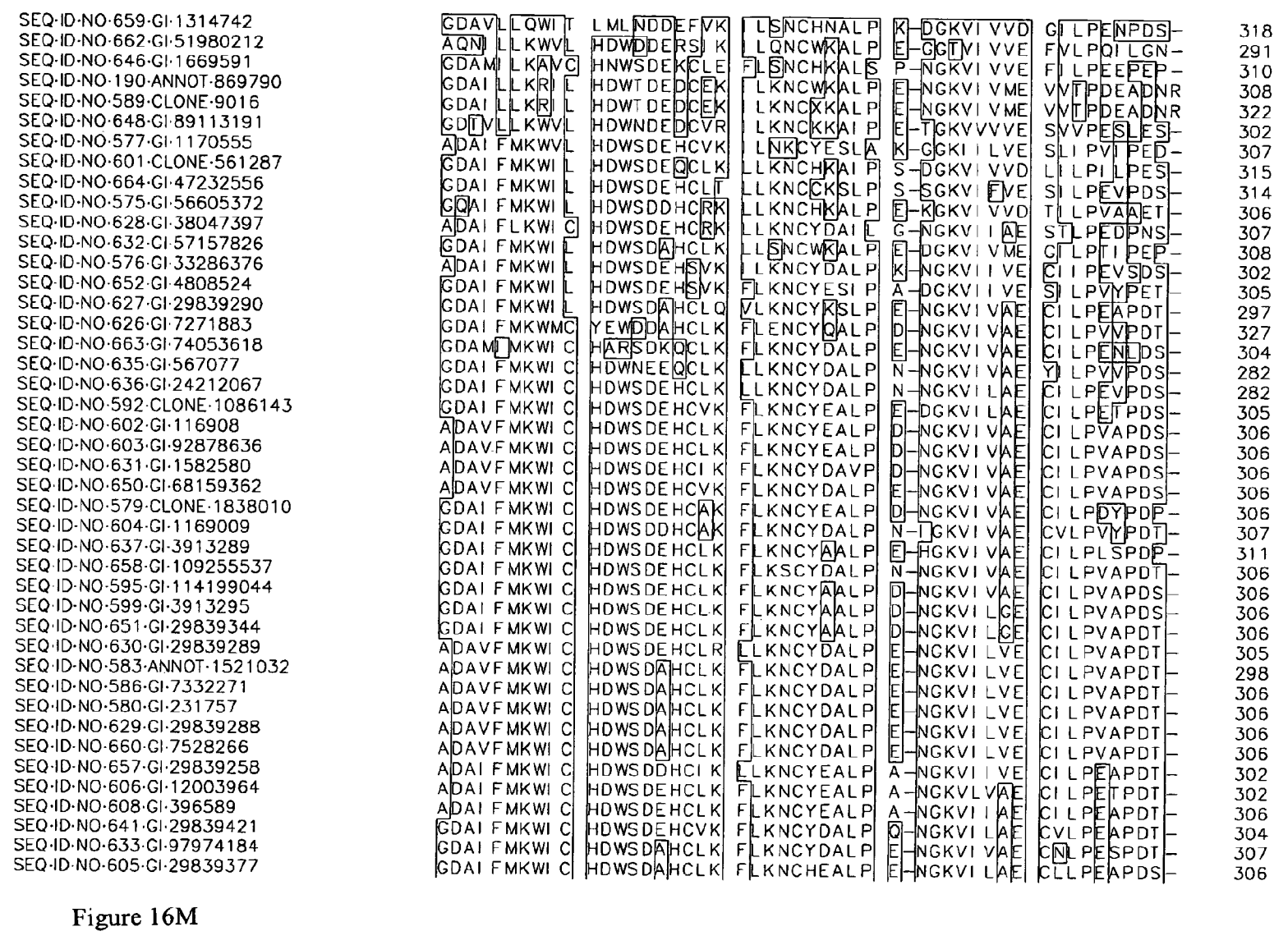
Figure 16O:
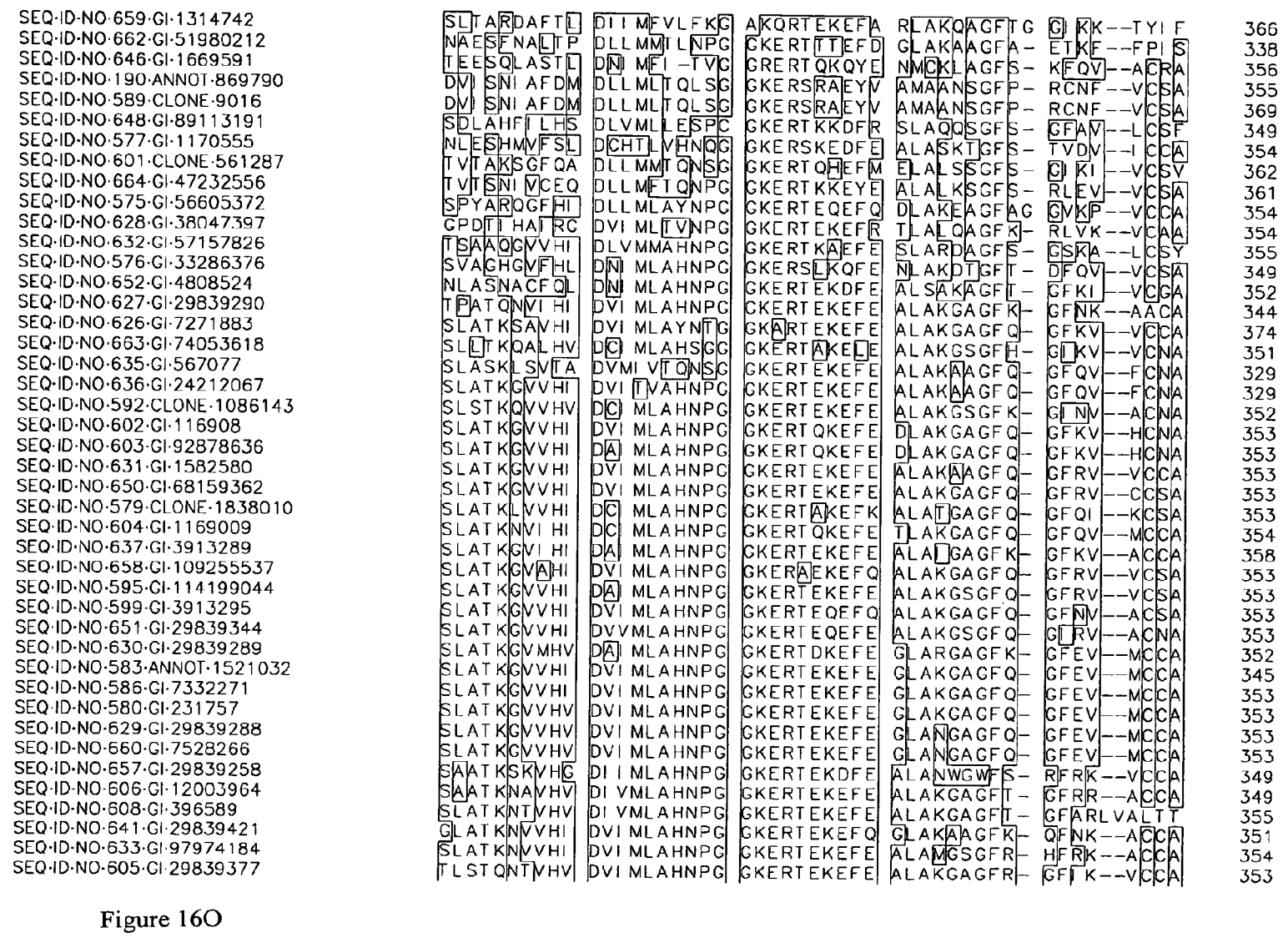
Figure 16Q:
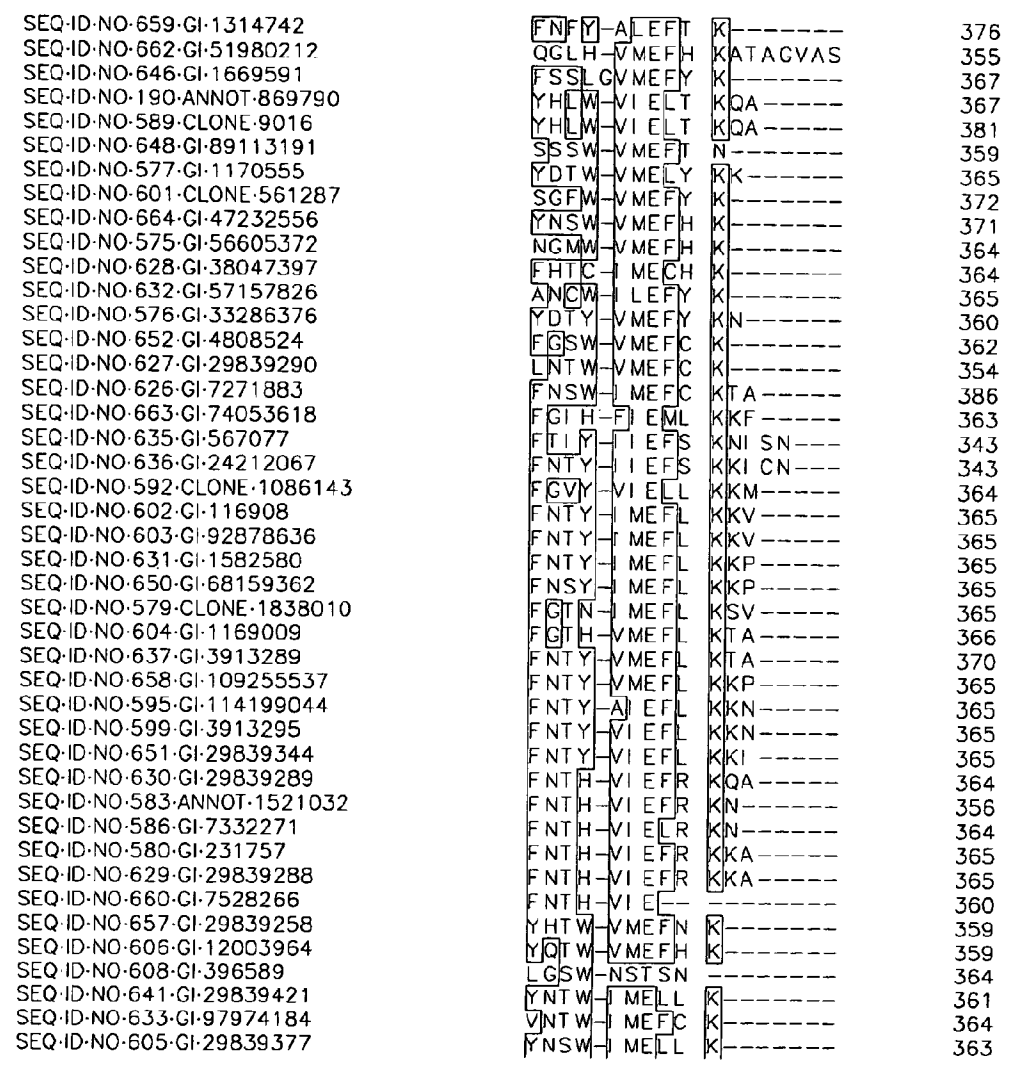

Amino acid sequences of homologs and/or orthologs of the polypeptide having the amino acid sequence set forth in SEQ ID NO:190 are provided in FIGS. 16A-16R. For example, the alignment in FIGS. 16A-16R provides the amino acid sequences of Annot ID 869790 (SEQ ID NO:190), gi|56605372 (SEQ ID NO:575), gi|33286376 (SEQ ID NO:576), gi|1170555 (SEQ ID NO:577), CeresClone 1838010 (SEQ ID NO:579), gi|231757 (SEQ ID NO:580), Annot ID 1521032 (SEQ ID NO:583), gi|7332271 (SEQ ID NO:586), CeresClone 9016 (SEQ ID NO:589), CeresClone 1086143 (SEQ ID NO:592), gi|114199044 (SEQ ID NO:595), gi|3913295 (SEQ ID NO:599), CeresClone 561287 (SEQ ID NO:601), gi|116908 (SEQ ID NO:602), gi|92878636 (SEQ ID NO:603), gi|1169009 (SEQ ID NO:604), gi|29839377 (SEQ ID NO:605), gi|12003964 (SEQ ID NO:606), gi|396589 (SEQ ID NO:608), gi|4104224 (SEQ ID NO:610), gi|29839259 (SEQ ID NO:613), gi|18033964 (SEQ ID NO:614), gi|77818928 (SEQ ID NO:616), CeresClone 1064285 (SEQ ID NO:621), gi|14578615 (SEQ ID NO:622), gi|7271883 (SEQ ID NO:626), gi|29839290 (SEQ ID NO:627), gi|38047397 (SEQ ID NO:628), gi|29839288 (SEQ ID NO:629), gi|29839289 (SEQ ID NO:630), gi|1582580 (SEQ ID NO:631), gi|57157826 (SEQ ID NO:632), gi|97974184 (SEQ ID NO:633), gi|567077 (SEQ ID NO:635), gi|24212067 (SEQ ID NO:636), gi|3913289 (SEQ ID NO:637), CeresClone 1869486 (SEQ ID NO:640), gi|29839421 (SEQ ID NO:641), gi|125560205 (SEQ ID NO:643), gi|125602246 (SEQ ID NO:644), gi|1669591 (SEQ ID NO:646), gi|22652500 (SEQ ID NO:647), gi|89113191 (SEQ ID NO:648), gi|68159362 (SEQ ID NO:650), gi|29839344 (SEQ ID NO:651), gi|4808524 (SEQ ID NO:652), gi|29839258 (SEQ ID NO:657), gi|109255537 (SEQ ID NO:658), gi|1314742 (SEQ ID NO:659), gi|7528266 (SEQ ID NO:660), gi|51980212 (SEQ ID NO:662), gi|74053618 (SEQ ID NO:663), and gi|47232556 (SEQ ID NO:664).

Other homologs and/or orthologs of SEQ ID NO:190 include gi|29839286 (SEQ ID NO:581), Annot ID 1472909 (SEQ ID NO:585), gi|444327 (SEQ ID NO:587), gi|21617938 (SEQ ID NO:590), CeresClone 1118817 (SEQ ID NO:594), gi|114199048 (SEQ ID NO:596), gi|114199046 (SEQ ID NO:597), gi|114199050 (SEQ ID NO:598), gi|30315948 (SEQ ID NO:607), gi|396591 (SEQ ID NO:609), gi|2388664 (SEQ ID NO:611), gi|4104220 (SEQ ID NO:612), gi|28569609 (SEQ ID NO:615), gi|30385246 (SEQ ID NO:617), gi|570057 (SEQ ID NO:619), gi|14578611 (SEQ ID NO:623), gi|14578613 (SEQ ID NO:624), gi|14578617 (SEQ ID NO:625), gi|97974173 (SEQ ID NO:634), gi|38502831 (SEQ ID NO:638), gi|29839420 (SEQ ID NO:642), gi|115474869 (SEQ ID NO:645), gi|89113193 (SEQ ID NO:649), gi|4808526 (SEQ ID NO:653), gi|4808530 (SEQ ID NO:654), gi|4808528 (SEQ ID NO:655), gi|4808522 (SEQ ID NO:656), and gi|34398680 (SEQ ID NO:661).

Figure 17A:
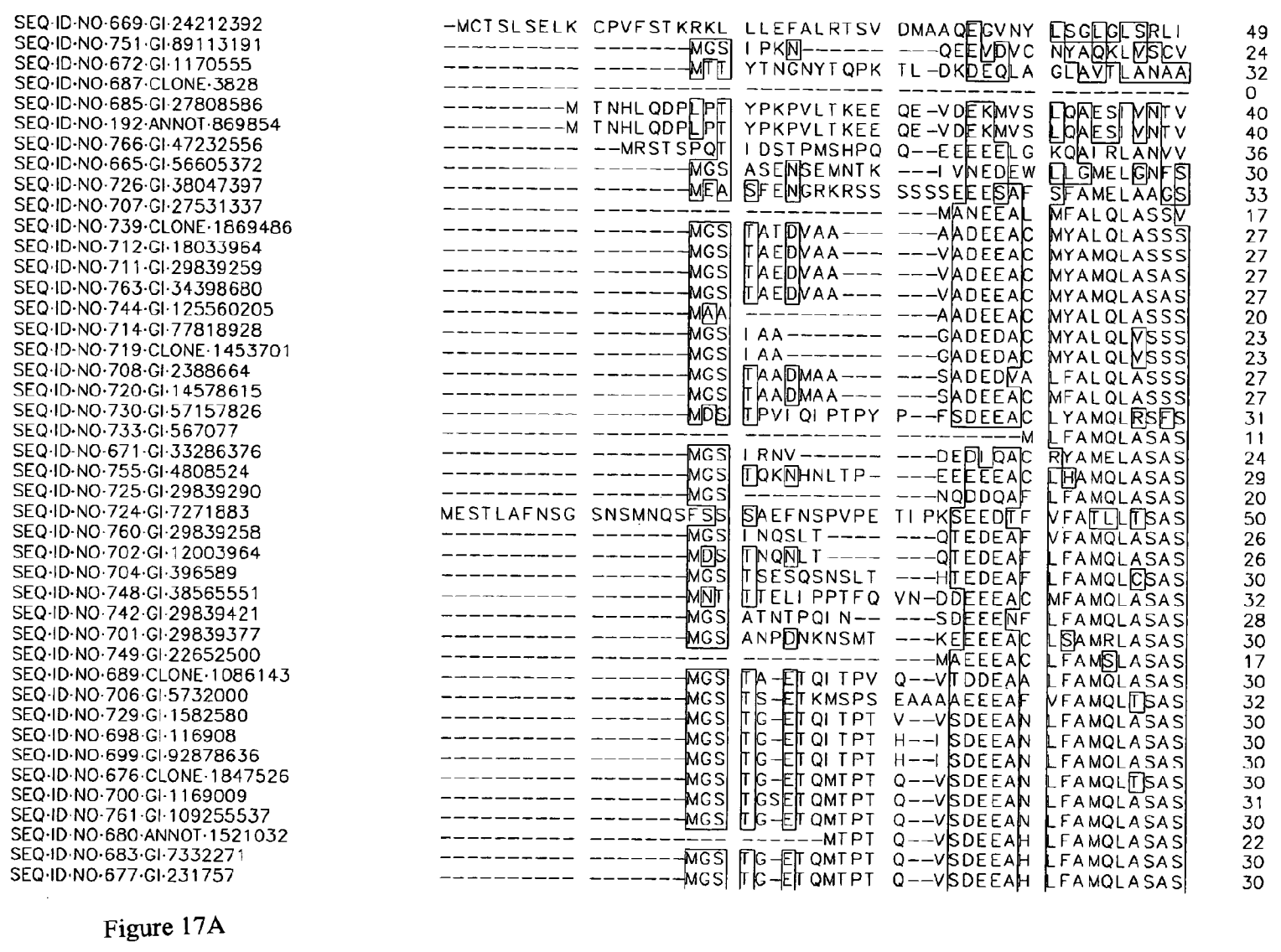
Figure 17C:
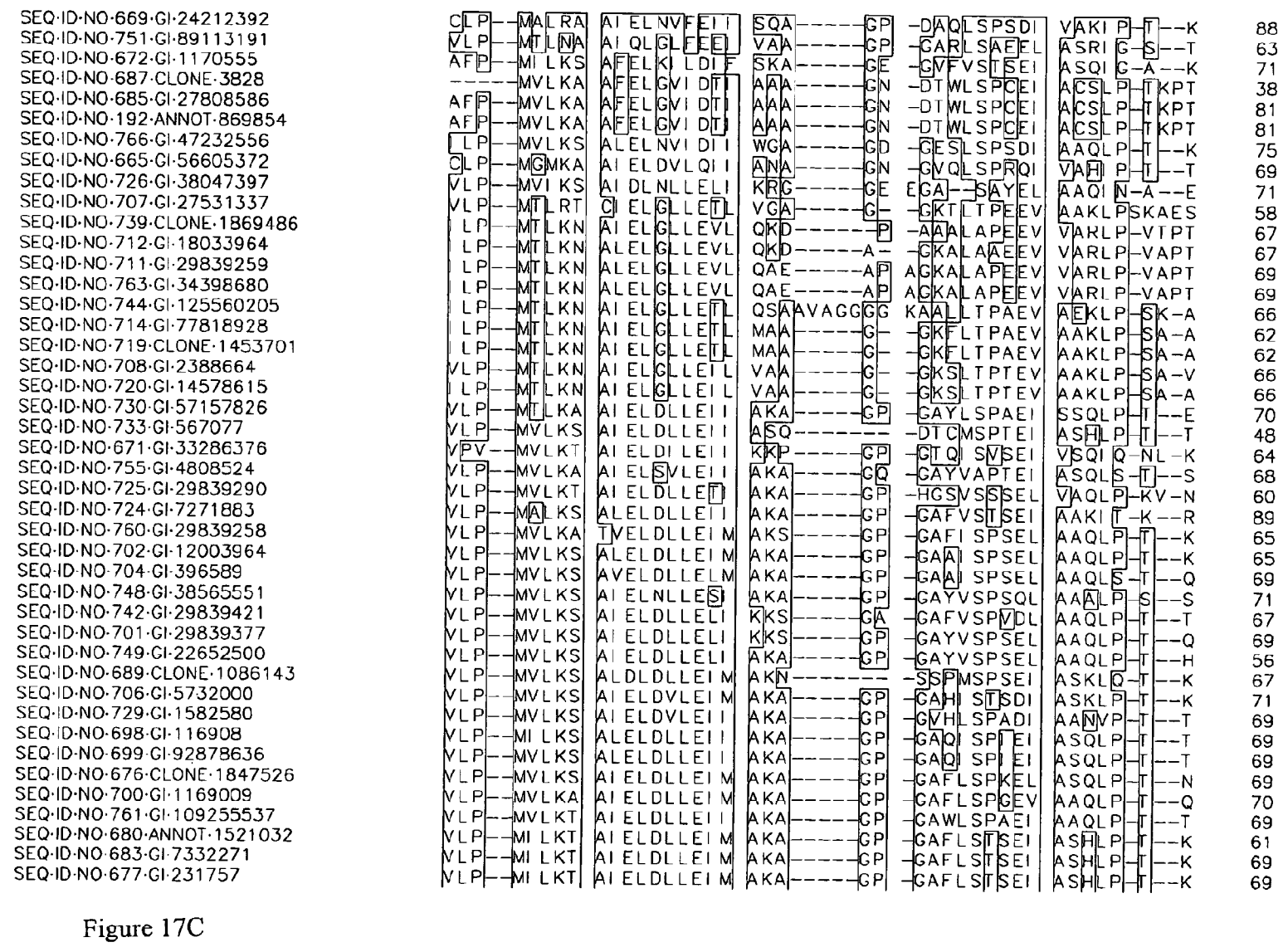
Figure 17E:
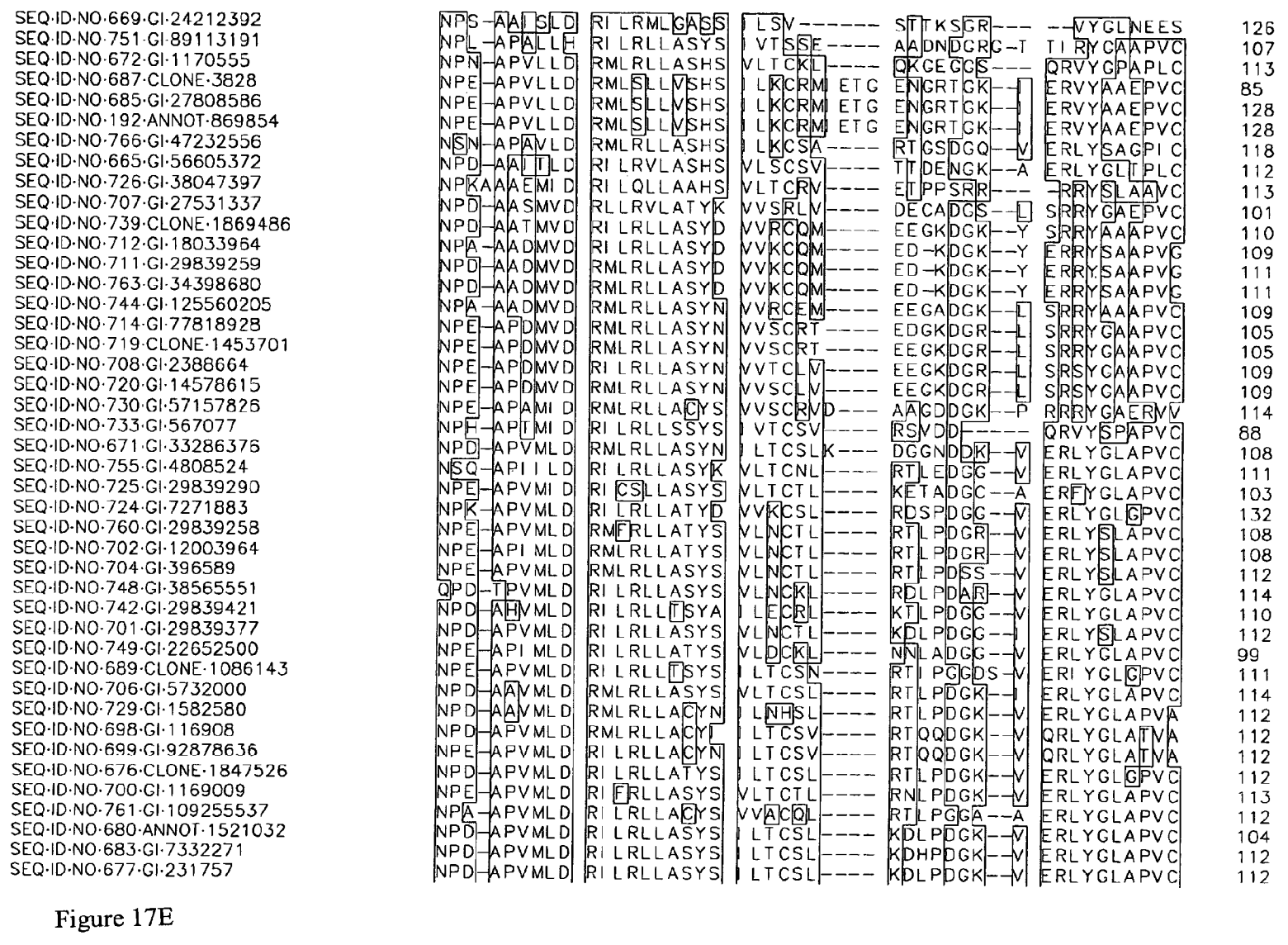
Figure 17F:
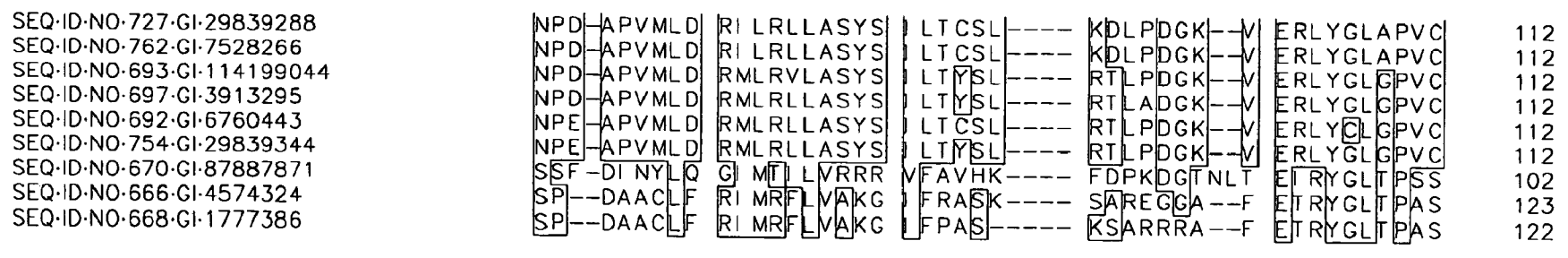
Figure 17G:
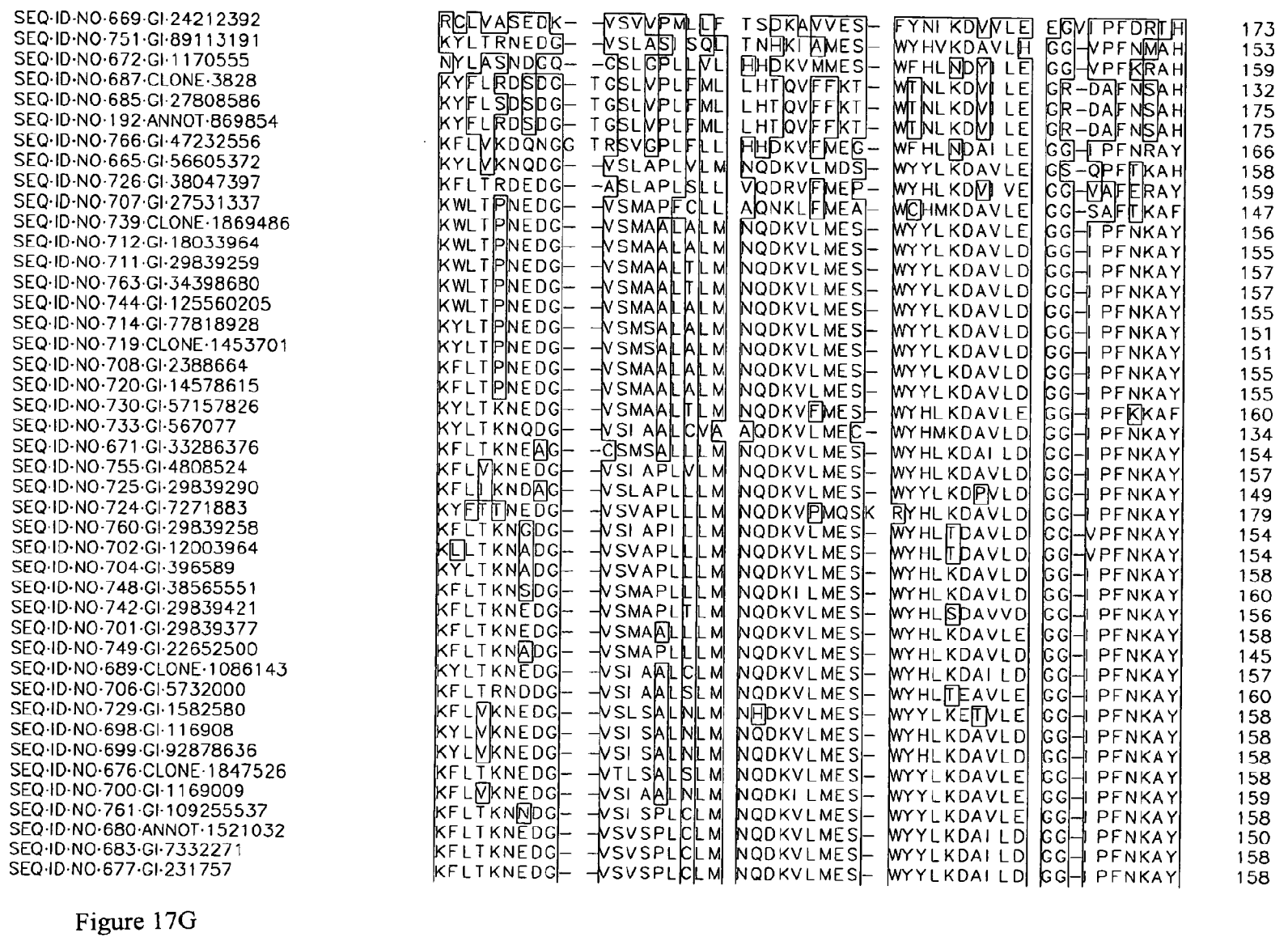
Figure 17I:
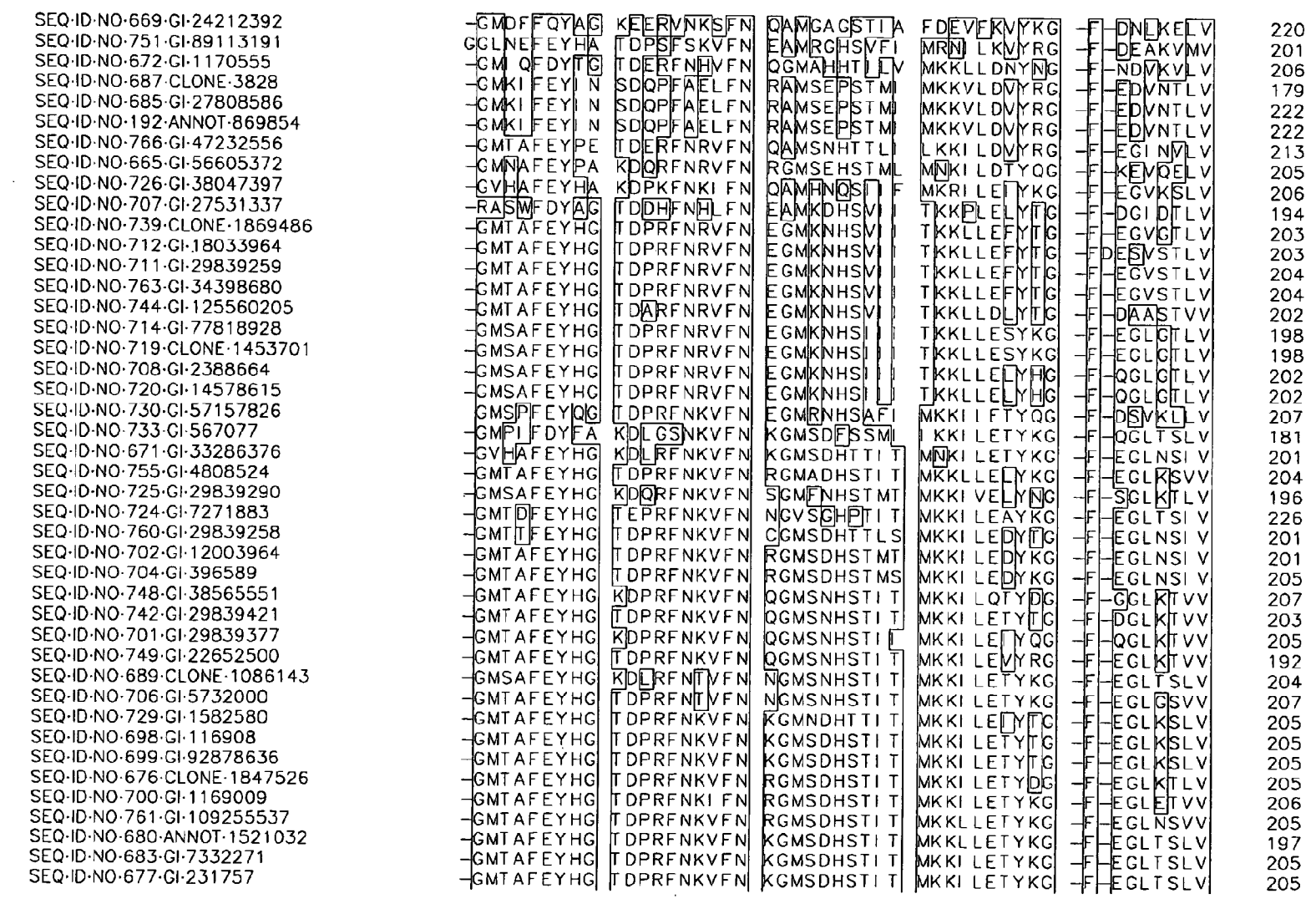
Figure 17K:
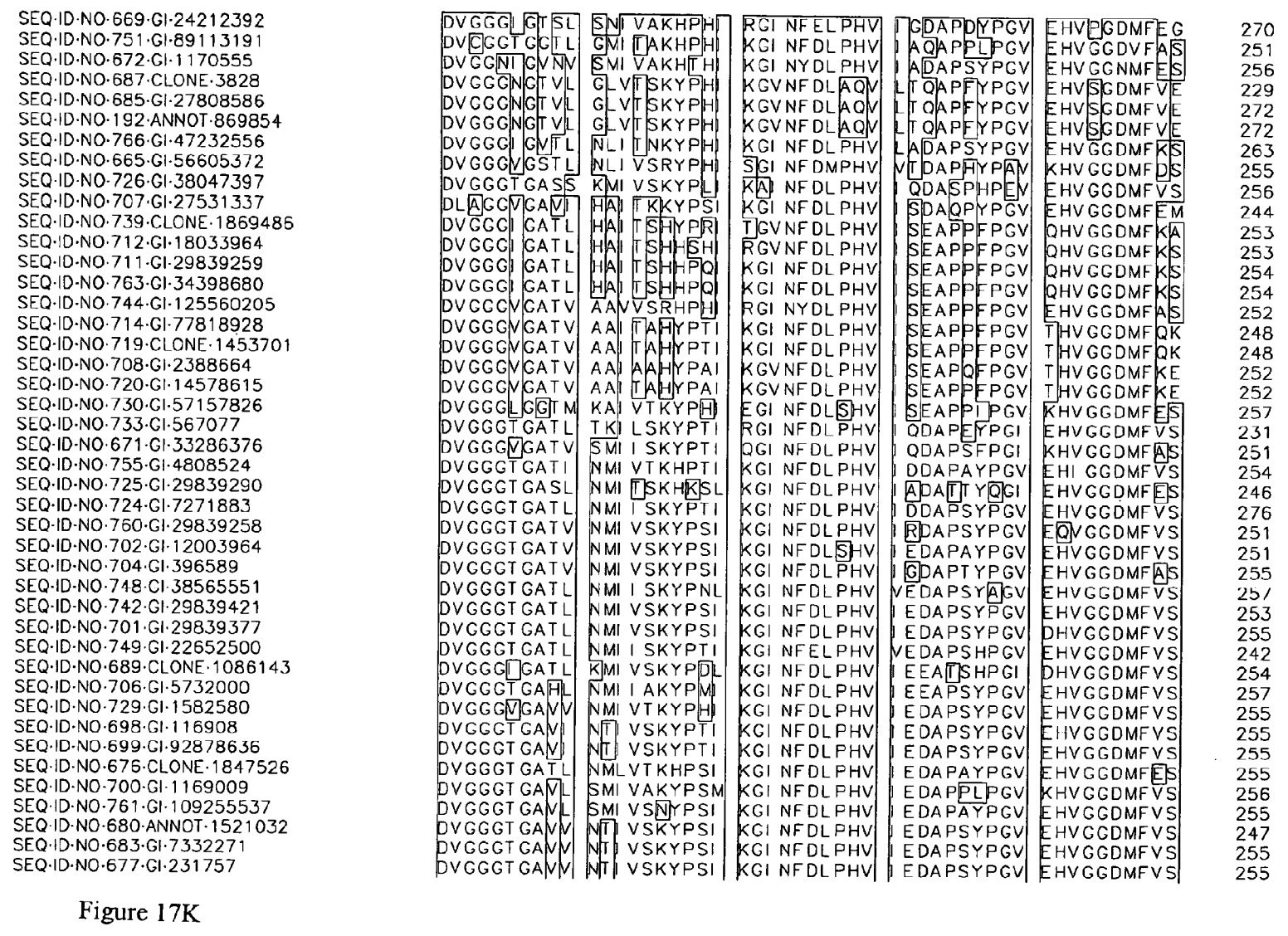
Figure 17M:
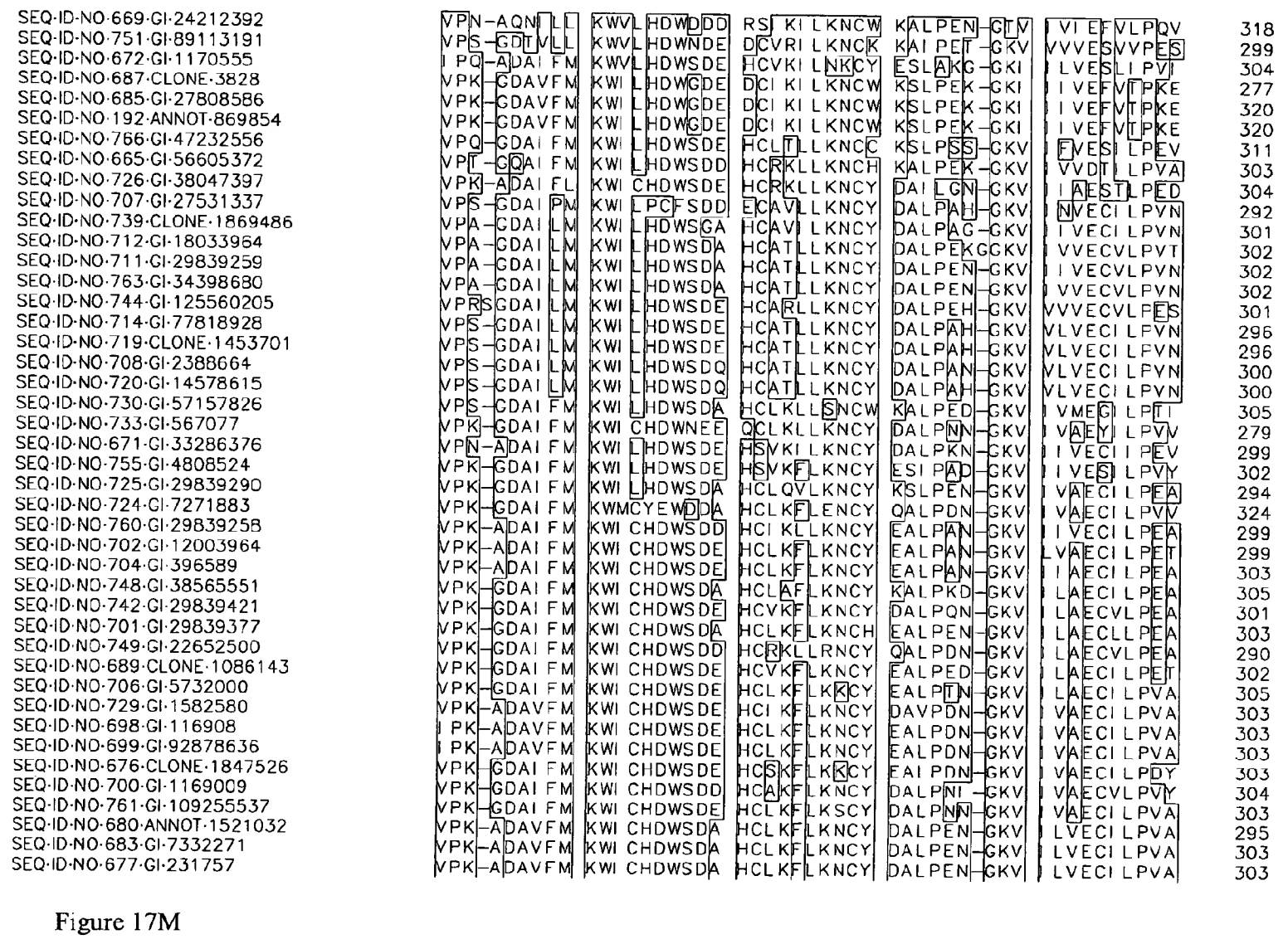
Figure 17O:
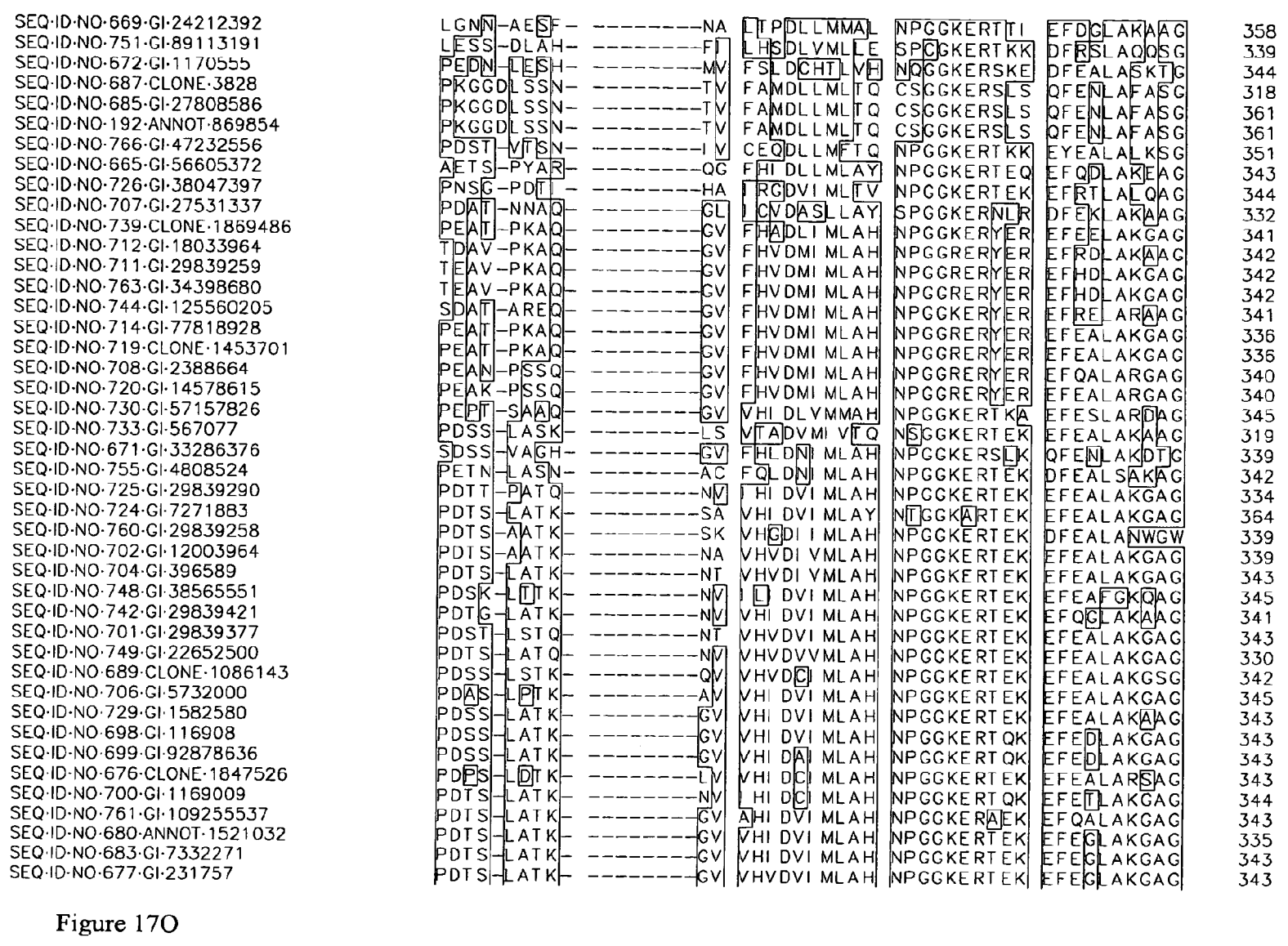
Figure 17Q:
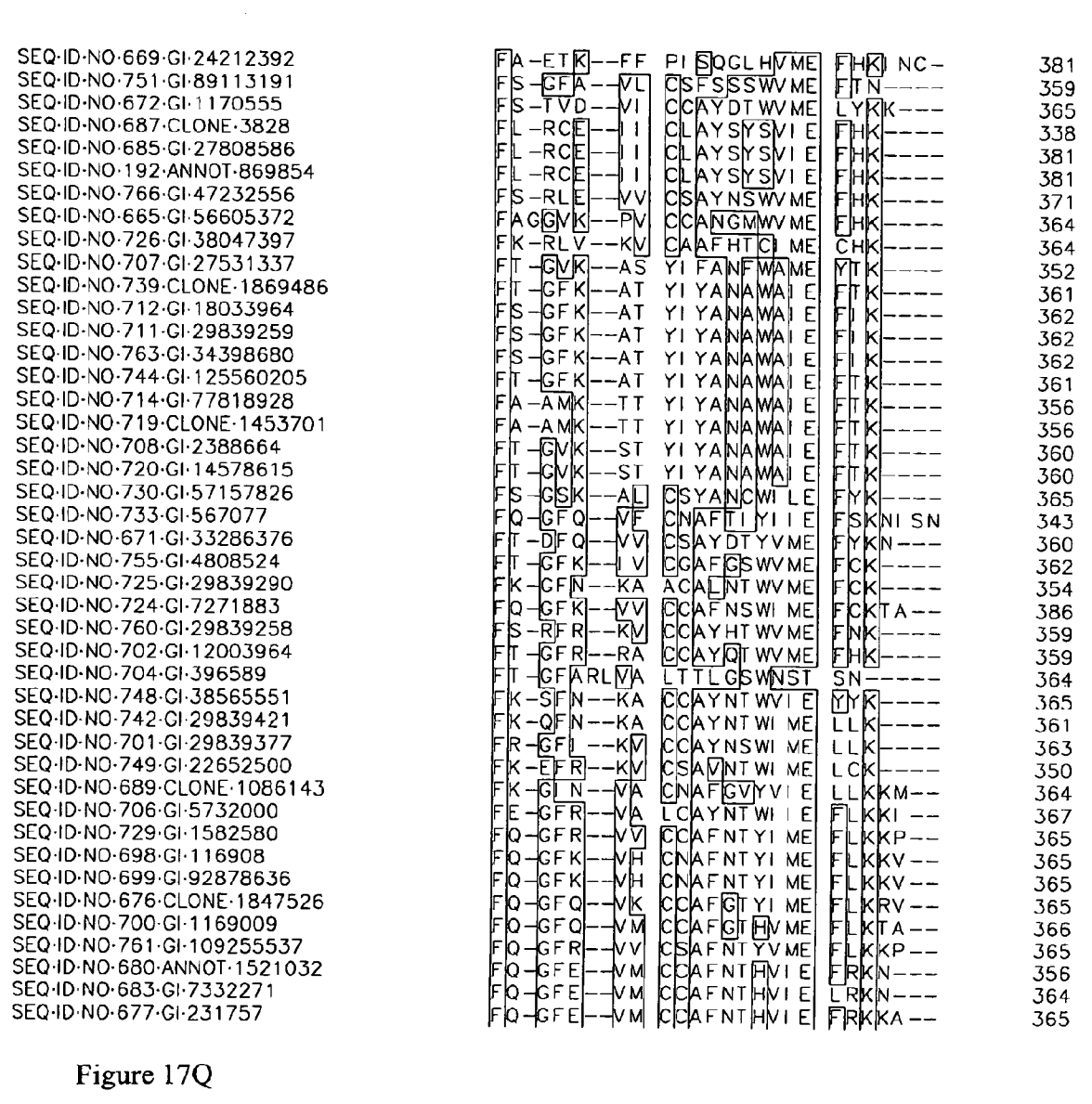

Amino acid sequences of homologs and/or orthologs of the polypeptide having the amino acid sequence set forth in SEQ ID NO:192 are provided in FIGS. 17A-17R. For example, the alignment in FIGS. 17A-17R provides the amino acid sequences of Annot ID 1365873 (SEQ ID NO:192), gi|56605372 (SEQ ID NO:665), gi|4574324 (SEQ ID NO:666), gi|1777386 (SEQ ID NO:668), gi|24212392 (SEQ ID NO:669), gi|87887871 (SEQ ID NO:670), gi|33286376 (SEQ ID NO:671), gi|1170555 (SEQ ID NO:672), CeresClone 1847526 (SEQ ID NO:676), gi|231757 (SEQ ID NO:677), Annot ID 1521032 (SEQ ID NO:680), gi|7332271 (SEQ ID NO:683), gi|27808586 (SEQ ID NO:685), CeresClone 3828 (SEQ ID NO:687), CeresClone 1086143 (SEQ ID NO:689), gi|6760443 (SEQ ID NO:692), gi|114199044 (SEQ ID NO:693), gi|3913295 (SEQ ID NO:697), gi|116908 (SEQ ID NO:698), gi|92878636 (SEQ ID NO:699), gi|1169009 (SEQ ID NO:700), gi|29839377 (SEQ ID NO:701), gi|12003964 (SEQ ID NO:702), gi|396589 (SEQ ID NO:704), gi|5732000 (SEQ ID NO:706), gi|27531337 (SEQ ID NO:707), gi|2388664 (SEQ ID NO:708), gi|29839259 (SEQ ID NO:711), gi|18033964 (SEQ ID NO:712), gi|77818928 (SEQ ID NO:714), CeresClone 1453701 (SEQ ID NO:719), gi|14578615 (SEQ ID NO:720), gi|7271883 (SEQ ID NO:724), gi|29839290 (SEQ ID NO:725), gi|38047397 (SEQ ID NO:726), gi|29839288 (SEQ ID NO:727), gi|1582580 (SEQ ID NO:729), gi|57157826 (SEQ ID NO:730), gi|567077 (SEQ ID NO:733), CeresClone 1869486 (SEQ ID NO:739), gi|29839421 (SEQ ID NO:742), gi|125560205 (SEQ ID NO:744), gi|38565551 (SEQ ID NO:748), gi|22652500 (SEQ ID NO:749), gi|89113191 (SEQ ID NO:751), gi|29839344 (SEQ ID NO:754) gi|4808524 (SEQ ID NO:755), gi|29839258 (SEQ ID NO:760), gi|109255537 (SEQ ID NO:761), gi|7528266 (SEQ ID NO:762), gi|34398680 (SEQ ID NO:763), and gi|47232556 (SEQ ID NO:766).

Other homologs and/or orthologs of SEQ ID NO:192 include gi|1568664 (SEQ ID NO:667), CeresClone 1838010 (SEQ ID NO:674), gi|29839286 (SEQ ID NO:678), Annot ID 1472909 (SEQ ID NO:682), gi|444327 (SEQ ID NO:684), CeresClone 118817 (SEQ ID NO:691), gi|114199046 (SEQ ID NO:694), gi|114199048 (SEQ ID NO:695), gi|114199050 (SEQ ID NO:696), gi|30315948 (SEQ ID NO:703), gi|396591 (SEQ ID NO:705), gi|4104224 (SEQ ID NO:709), gi|4104220 (SEQ ID NO:710), gi|28569609 (SEQ ID NO:713), CeresClone 570057 (SEQ ID NO:716), gi|30385246 (SEQ ID NO:717), gi|14578613 (SEQ ID NO:721), gi|14578611 (SEQ ID NO:722), gi|14578617 (SEQ ID NO:723), gi|29839289 (SEQ ID NO:728), gi|97974184 (SEQ ID NO:731), gi|97974173 (SEQ ID NO:732), gi|24212064 (SEQ ID NO:734), gi|24212067 (SEQ ID NO:735), gi|3913289 (SEQ ID NO:736), gi|38502831 (SEQ ID NO:737), CeresClone 1770156 (SEQ ID NO:741), gi|29839420 (SEQ ID NO:743), gi|115474869 (SEQ ID NO:745), gi|125602246 (SEQ ID NO:746), gi|1669591 (SEQ ID NO:747), gi|29839361 (SEQ ID NO:750), gi|89113193 (SEQ ID NO:752), gi|68159362 (SEQ ID NO:753), gi|4808528 (SEQ ID NO:756), gi|4808522 (SEQ ID NO:757), gi|4808526 (SEQ ID NO:758), gi|4808530 (SEQ ID NO:759), gi|51980212 (SEQ ID NO:764), and gi|74053618 (SEQ ID NO:765).

Figure 19A:
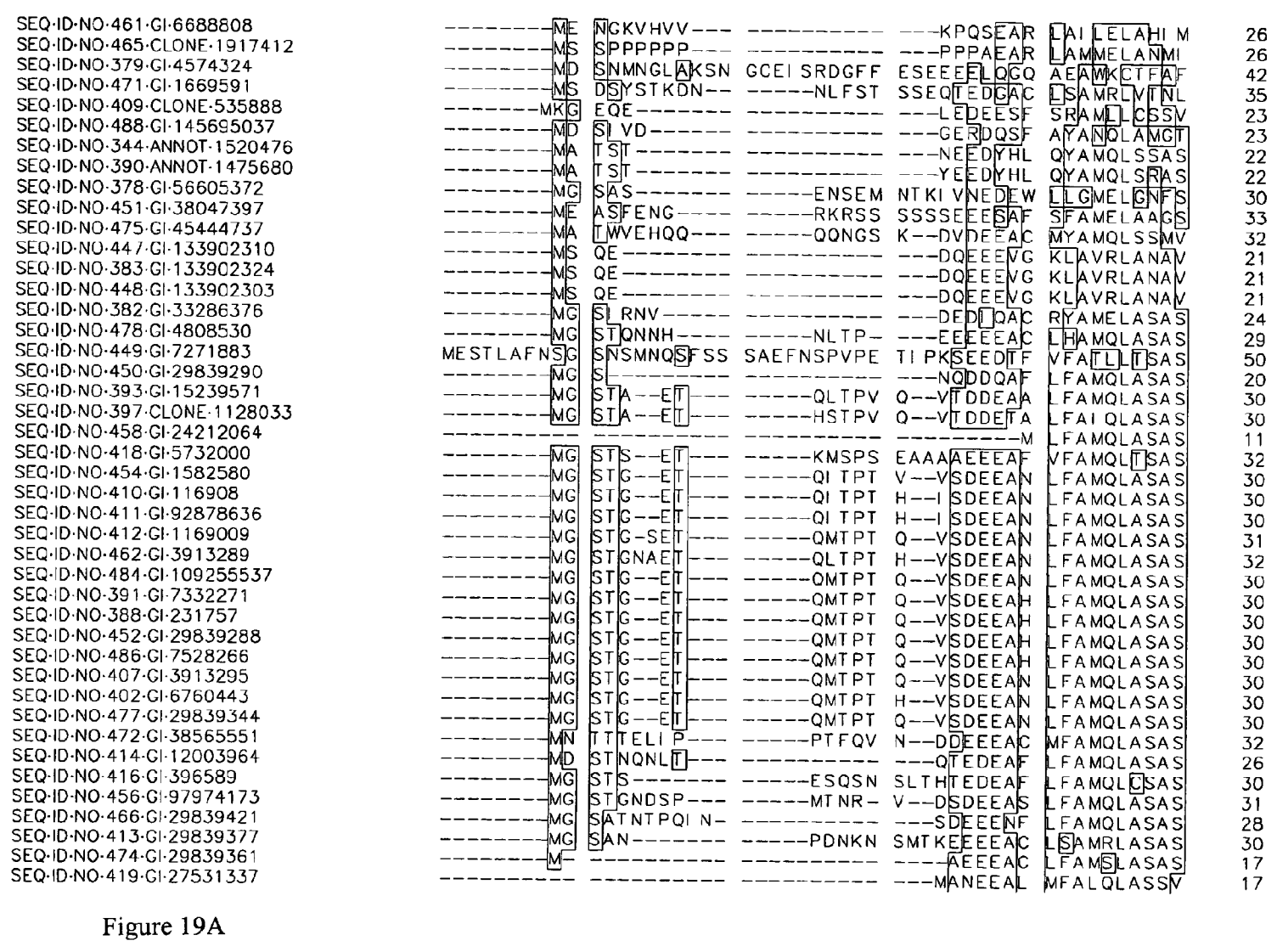
Figure 19C:
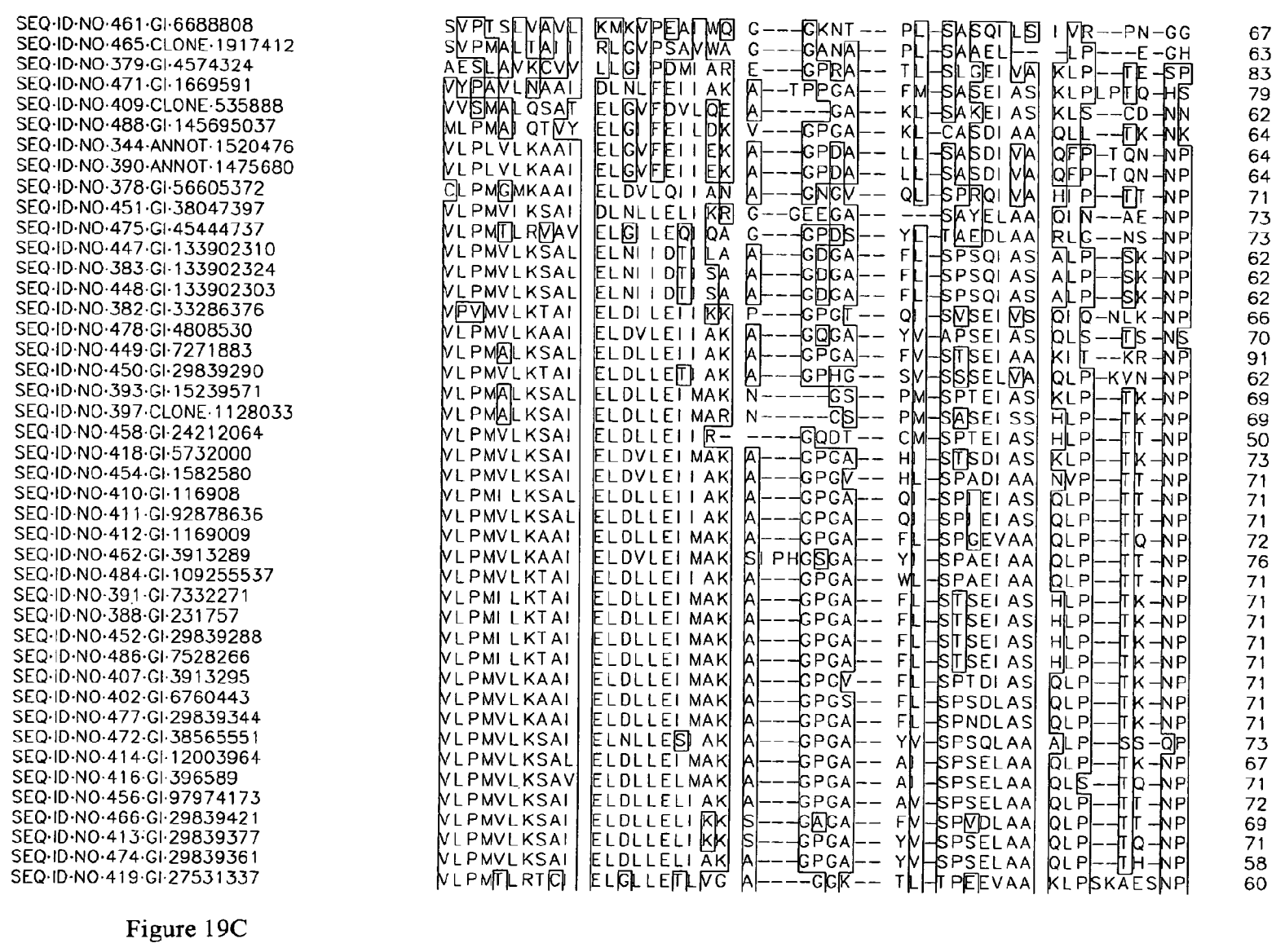
Figure 19E:
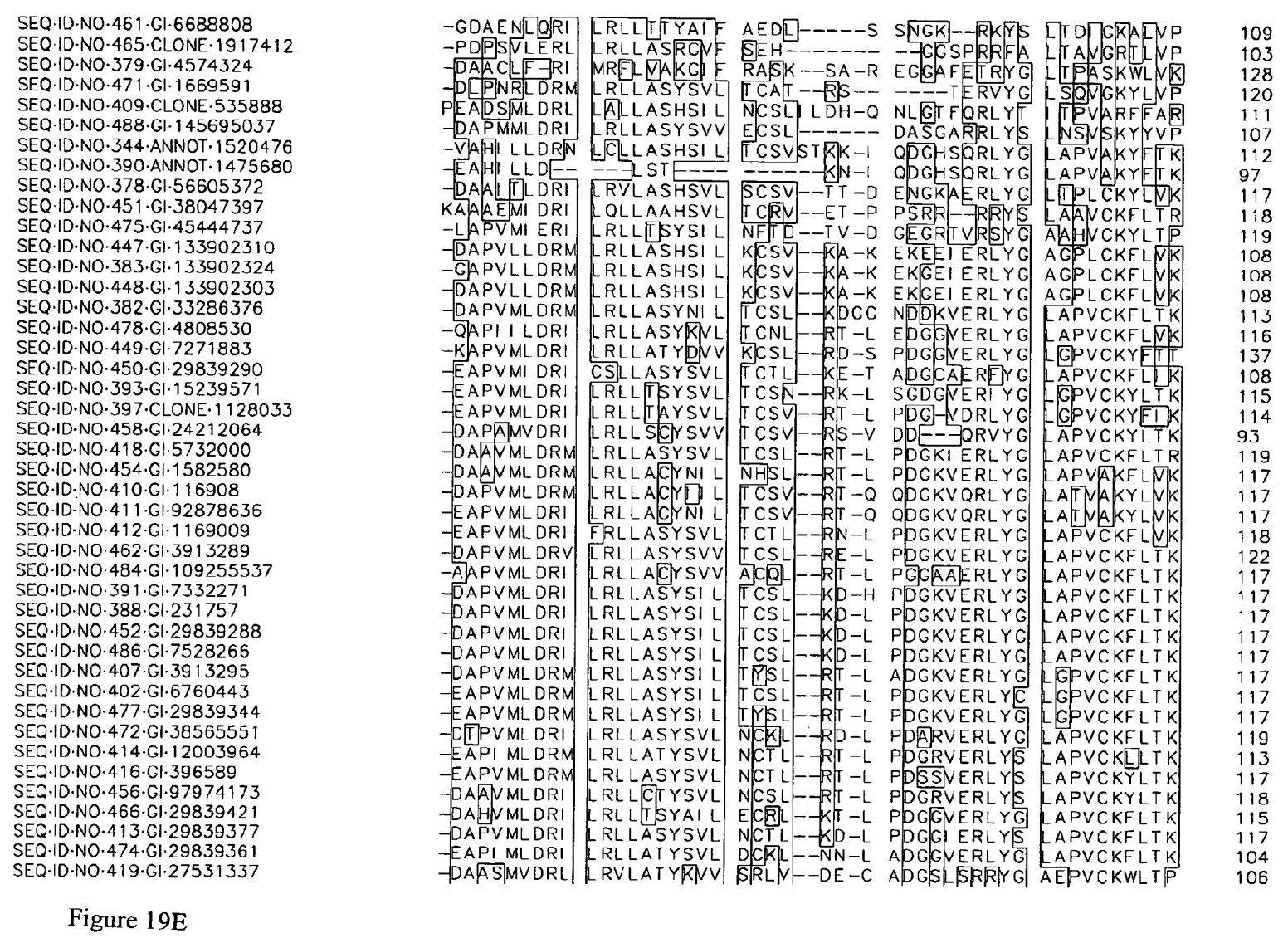
Figure 19G:
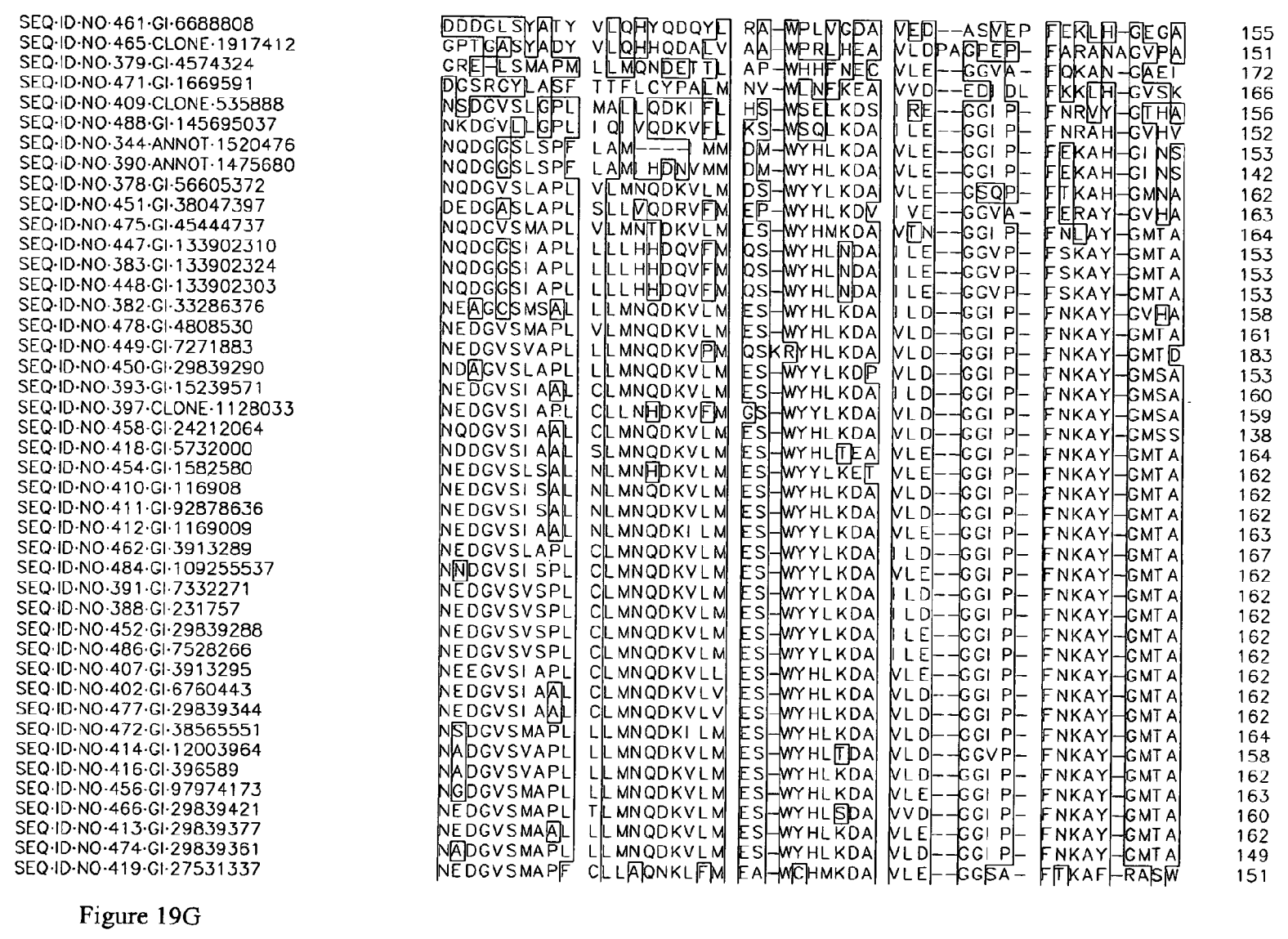
Figure 19I:
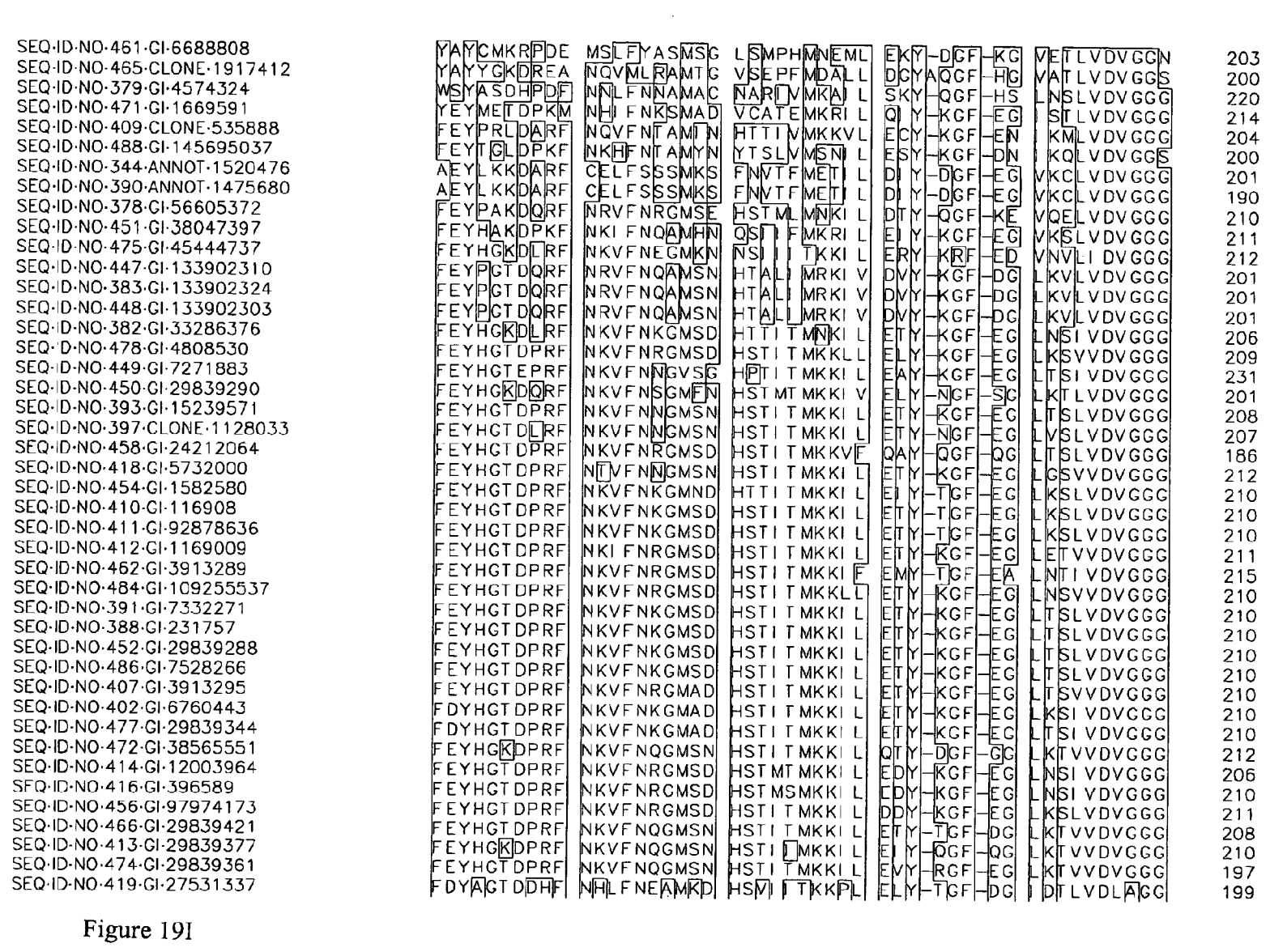
Figure 19K:
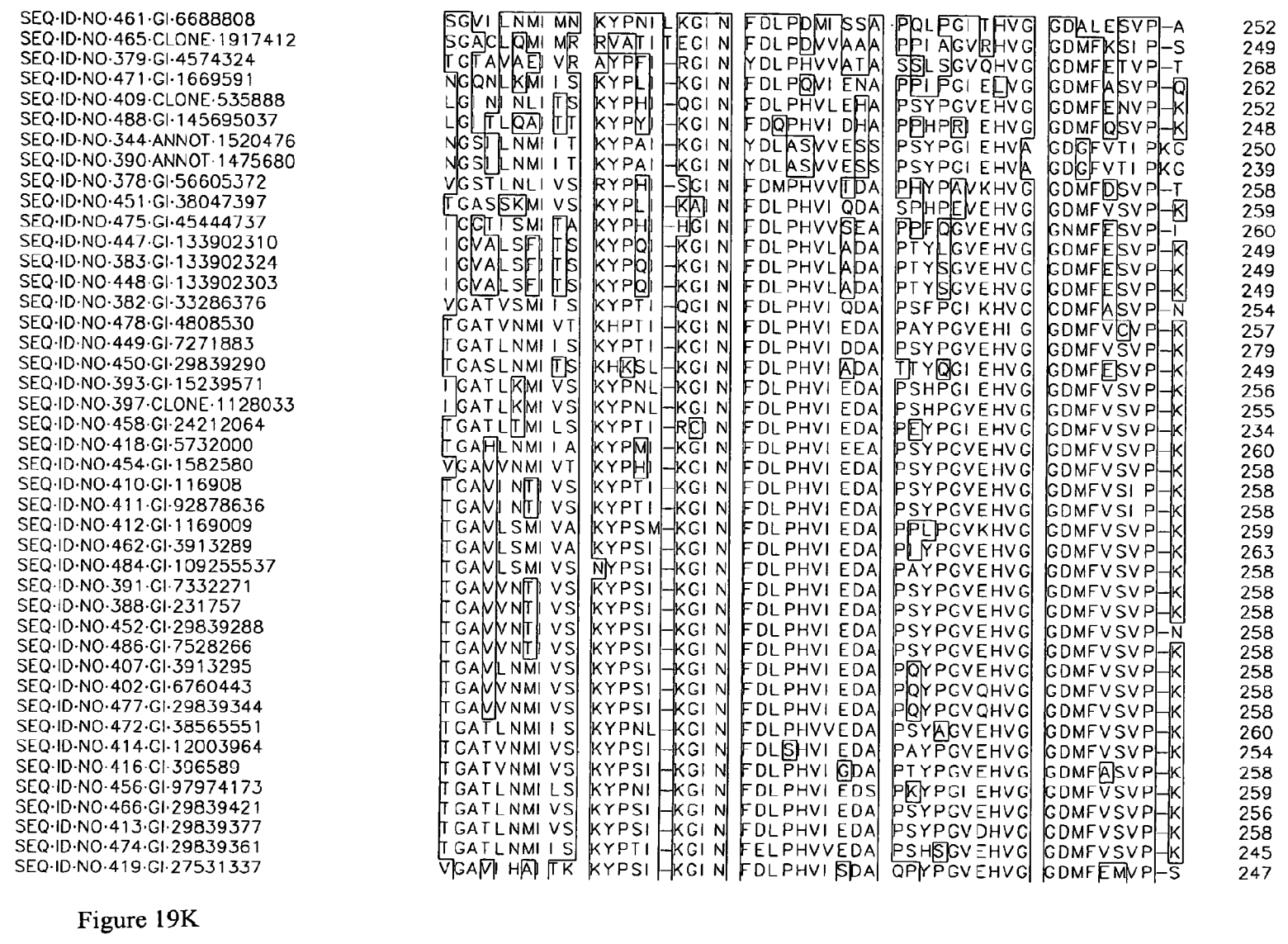
Figure 19M:
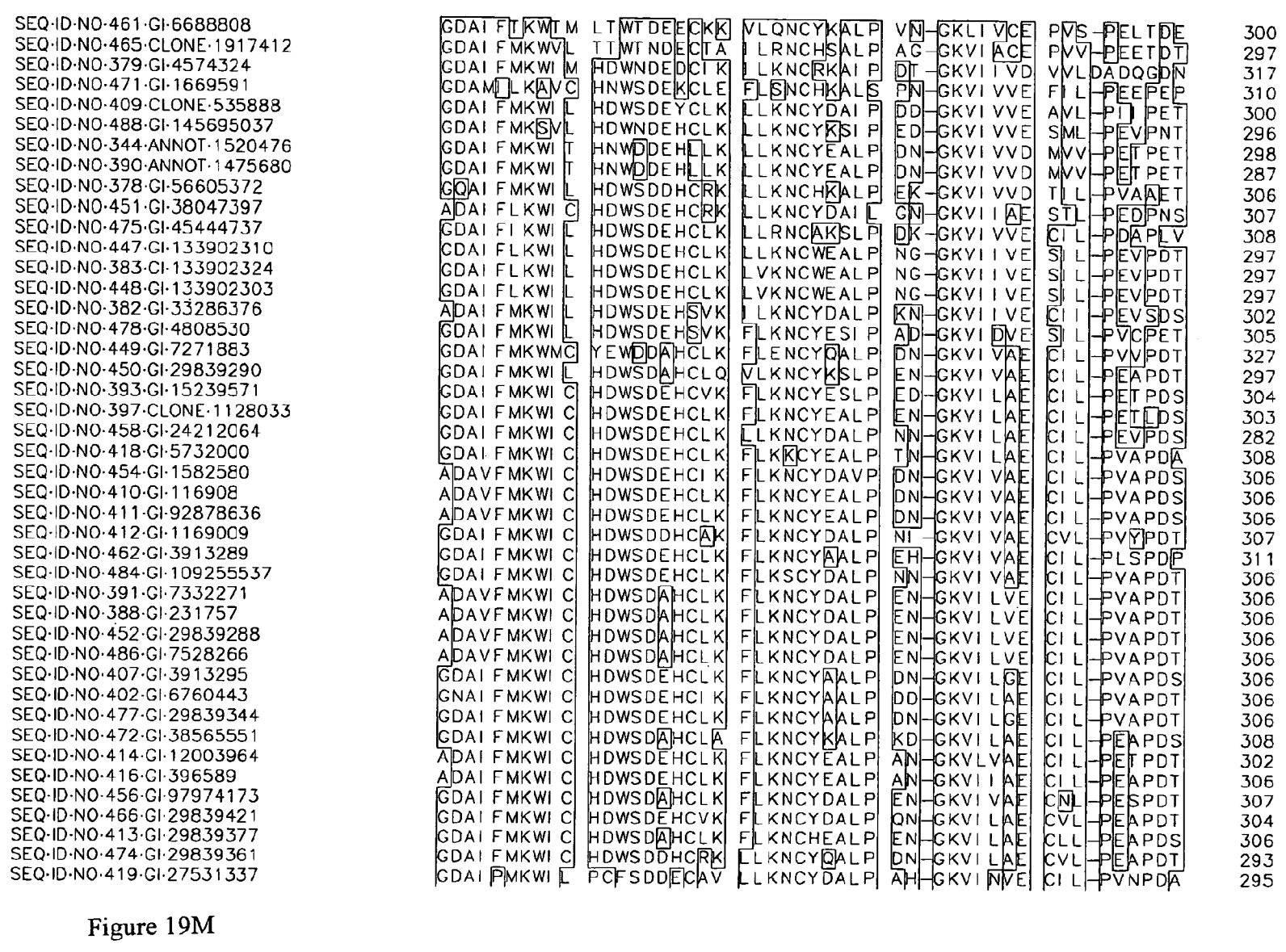
Figure 19Q:
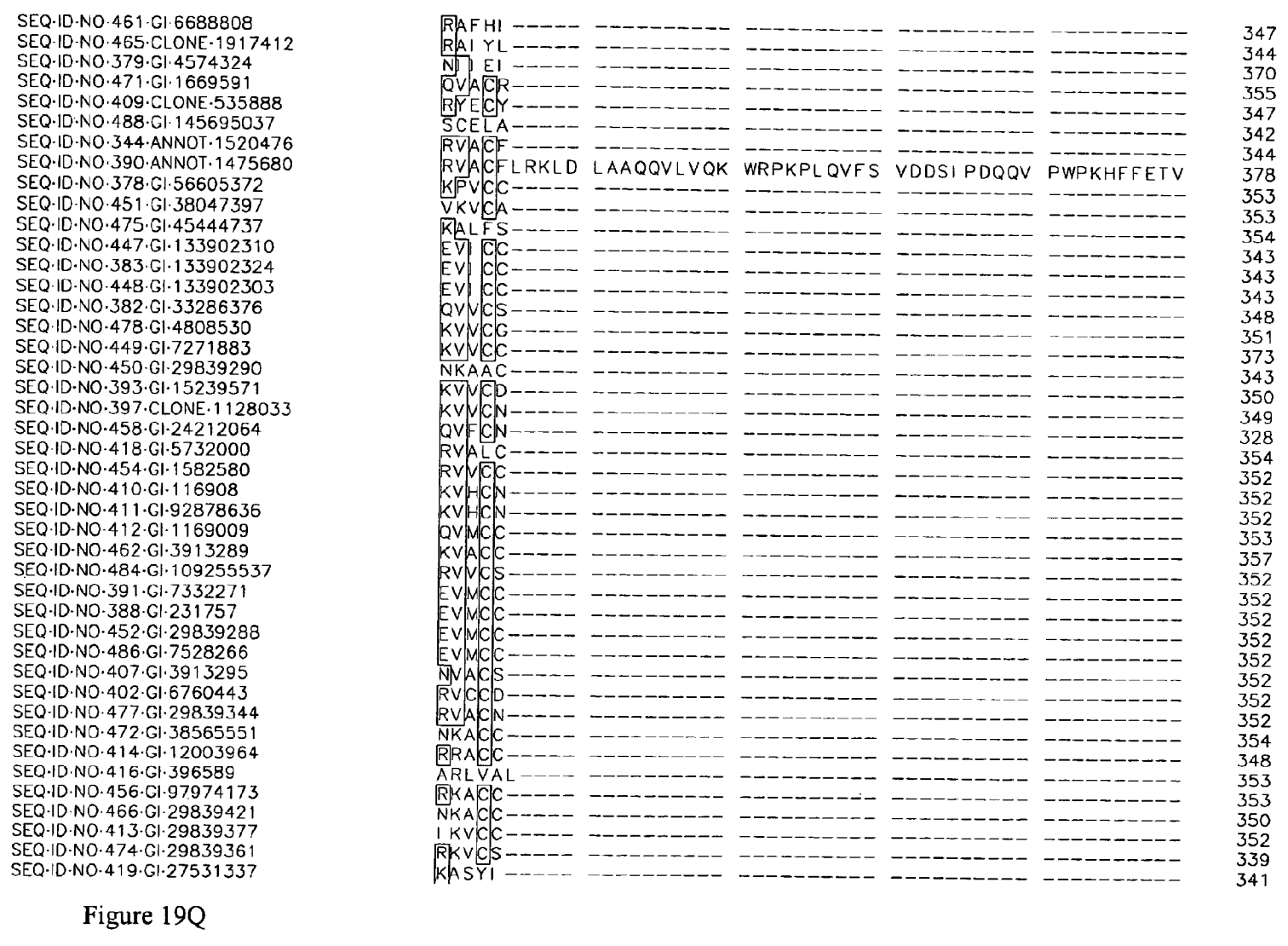
Figure 19R:
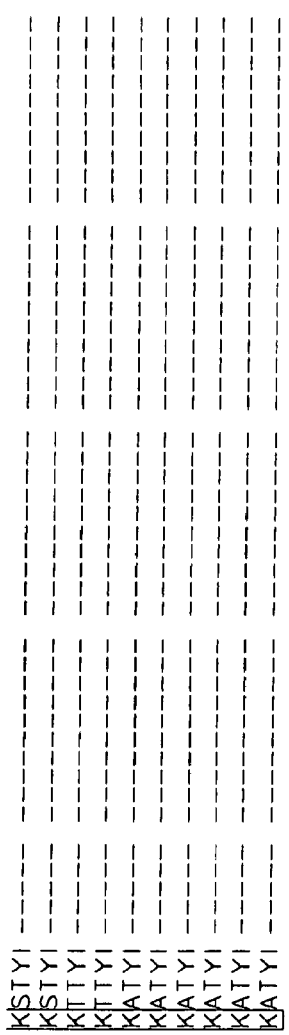
FIGS. 19A-19V are an alignment of the amino acid sequence of Annot ID 1520476 (SEQ ID NO:344) with homologous and/or orthologous amino acid sequences gi|56605372 (SEQ ID NO:378), gi|4574324 (SEQ ID NO:379), gi|33286376 (SEQ ID NO:382), gi|133902324 (SEQ ID NO:383), gi|231757 (SEQ ID NO:388), Annot ID 1475680 (SEQ ID NO:390), gi|7332271 (SEQ ID NO:391), gi|15239571 (SEQ ID NO:393), CeresClone 1128033 (SEQ ID NO:397), gi|6760443 (SEQ ID NO:402), gi|3913295 (SEQ ID NO:407), CeresClone 535888 (SEQ ID NO:409), gi|116908 (SEQ ID NO:410), gi|92878636 (SEQ ID NO:411), gi|1169009 (SEQ ID NO:412), gi|29839377 (SEQ ID NO:413), gi|12003964 (SEQ ID NO:414), gi|396589 (SEQ ID NO:416), gi|5732000 (SEQ ID NO:418), gi|27531337 (SEQ ID NO:419), gi|2388664 (SEQ ID NO:420), gi|29839259 (SEQ ID NO:423), gi|28569609 (SEQ ID NO:424), gi|30385246 (SEQ ID NO:426), gi|729135 (SEQ ID NO:430), gi|33641726 (SEQ ID NO:436), gi|14578613 (SEQ ID NO:443), gi|133902310 (SEQ ID NO:447), gi|133902303 (SEQ ID NO:448), gi|7271883 (SEQ ID NO:449), gi|29839290 (SEQ ID NO:450), gi|38047397 (SEQ ID NO:451), gi|29839288 (SEQ ID NO:452), gi|1582580 (SEQ ID NO:454), gi|97974173 (SEQ ID NO:456), gi|24212064 (SEQ ID NO:458), gi|6688808 (SEQ ID NO:461), gi|3913289 (SEQ ID NO:462), CeresClone 1917412 (SEQ ID NO:465), gi|29839421 (SEQ ID NO:466), gi|125560205 (SEQ ID NO:468), gi|115474869 (SEQ ID NO:469), gi|1669591 (SEQ ID NO:471), gi|38565551 (SEQ ID NO:472), gi|29839361 (SEQ ID NO:474), gi|45444737 (SEQ ID NO:475), gi|29839344 (SEQ ID NO:477), gi|4808530 (SEQ ID NO:478), gi|109255537 (SEQ ID NO:484), gi|148337324 (SEQ ID NO:485), gi|7528266 (SEQ ID NO:486), and gi|145695037 (SEQ ID NO:488).
Figure 19S:
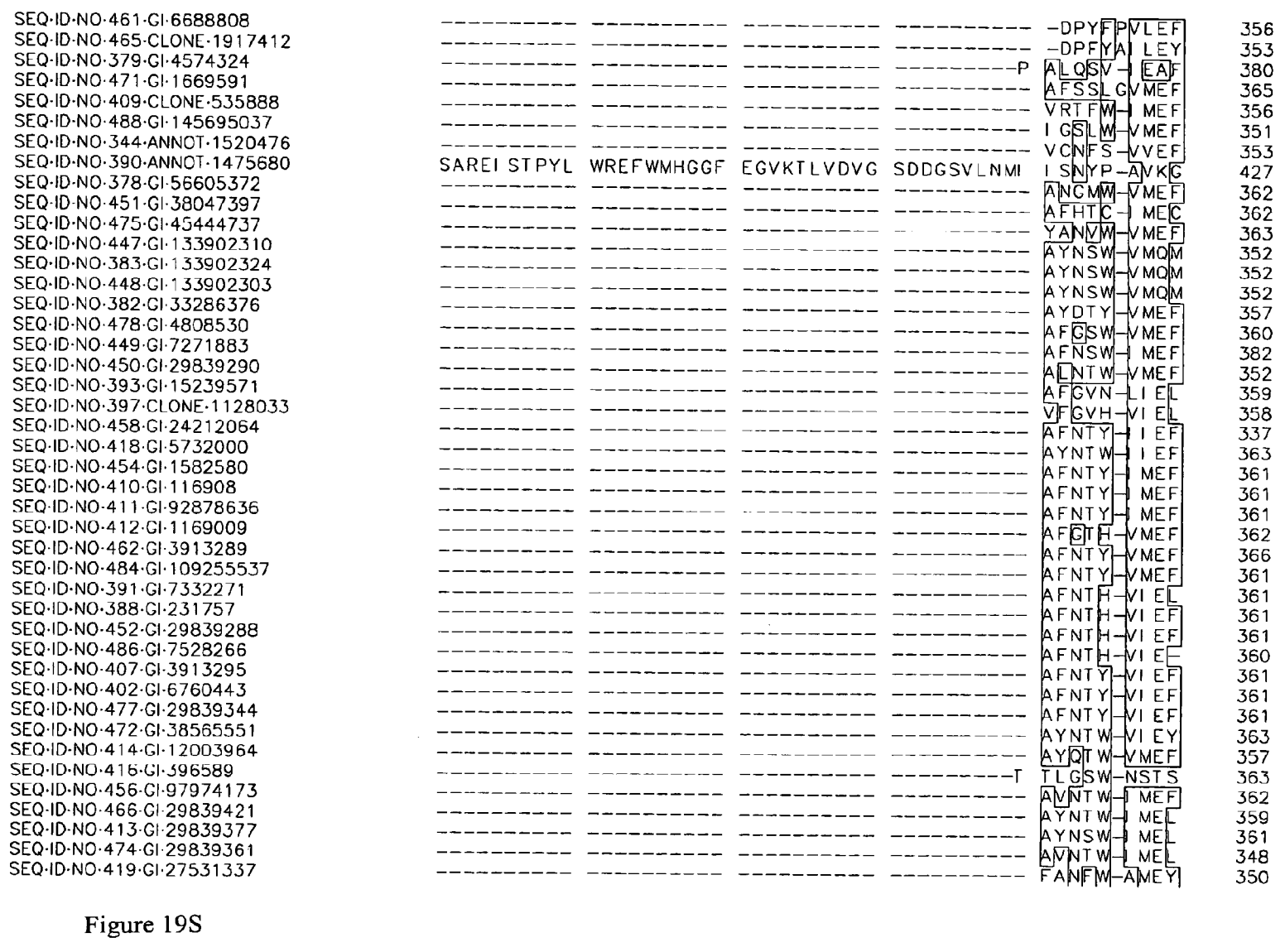
Figure 19V:
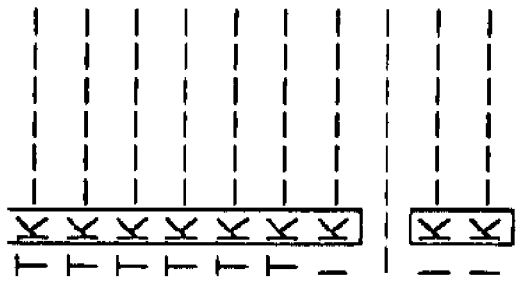

Amino acid sequences of homologs and/or orthologs of the polypeptide having the amino acid sequence set forth in SEQ ID NO:344 are provided in FIGS. 19A-19V. For example, the alignment in FIGS. 19A-19V provides the amino acid sequences of Annot ID 1520476 (SEQ ID NO:344), gi|56605372 (SEQ ID NO:378), gi|4574324 (SEQ ID NO:379), gi|33286376 (SEQ ID NO:382), gi|133902324 (SEQ ID NO:383), gi|231757 (SEQ ID NO:388), Annot ID 1475680 (SEQ ID NO:390), gi|7332271 (SEQ ID NO:391), gi|15239571 (SEQ ID NO:393), CeresClone 1128033 (SEQ ID NO:397), gi|6760443 (SEQ ID NO:402), gi|3913295 (SEQ ID NO:407), CeresClone 535888 (SEQ ID NO:409), gi|116908 (SEQ ID NO:410), gi|92878636 (SEQ ID NO:411), gi|1169009 (SEQ ID NO:412), gi|29839377 (SEQ ID NO:413), gi|12003964 (SEQ ID NO:414), gi|396589 (SEQ ID NO:416), gi|5732000 (SEQ ID NO:418), gi|27531337 (SEQ ID NO:419), gi|2388664 (SEQ ID NO:420), gi|29839259 (SEQ ID NO:423), gi|28569609 (SEQ ID NO:424), gi|30385246 (SEQ ID NO:426), gi|729135 (SEQ ID NO:430), gi|33641726 (SEQ ID NO:436), gi|14578613 (SEQ ID NO:443), gi|133902310 (SEQ ID NO:447), gi|133902303 (SEQ ID NO:448), gi|7271883 (SEQ ID NO:449), gi|29839290 (SEQ ID NO:450), gi|38047397 (SEQ ID NO:451), gi|29839288 (SEQ ID NO:452), gi|1582580 (SEQ ID NO:454), gi|97974173 (SEQ ID NO:456), gi|24212064 (SEQ ID NO:458), gi|6688808 (SEQ ID NO:461), gi|3913289 (SEQ ID NO:462), CeresClone 1917412 (SEQ ID NO:465), gi|29839421 (SEQ ID NO:466), gi|125560205 (SEQ ID NO:468), gi|115474869 (SEQ ID NO:469), gi|1669591 (SEQ ID NO:471), gi|38565551 (SEQ ID NO:472), gi|29839361 (SEQ ID NO:474), gi|45444737 (SEQ ID NO:475), gi|29839344 (SEQ ID NO:477), gi|4808530 (SEQ ID NO:478), gi|109255537 (SEQ ID NO:484), gi|148337324 (SEQ ID NO:485), gi|7528266 (SEQ ID NO:486), and gi|145695037 (SEQ ID NO:488).

Other homologs and/or orthologs of SEQ ID NO:344 include gi|1568664 (SEQ ID NO:380), gi|24212392 (SEQ ID NO:381), gi|133902316 (SEQ ID NO:384), gi|133902317 (SEQ ID NO:385), CeresClone 1930109 (SEQ ID NO:387), gi|444327 (SEQ ID NO:392), gi|2781394 (SEQ ID NO:394), gi|15223364 (SEQ ID NO:395), CeresClone 1118817 (SEQ ID NO:399), CeresClone 1091294 (SEQ ID NO:401), gi|114199048 (SEQ ID NO:403), gi|114199044 (SEQ ID NO:404), gi|114199046 (SEQ ID NO:405), gi|114199050 (SEQ ID NO:406), gi|30315948 (SEQ ID NO:415), gi|396591 (SEQ ID NO:417), gi|4104220 (SEQ ID NO:421), gi|4104224 (SEQ ID NO:422), gi|18033964 (SEQ ID NO:425), gi|77818928 (SEQ ID NO:427), gi|145693798 (SEQ ID NO:428), gi|145693796 (SEQ ID NO:429), gi|33641710 (SEQ ID NO:431), gi|33641704 (SEQ ID NO:432), gi|33641706 (SEQ ID NO:433), gi|33641708 (SEQ ID NO:434), gi|33641718 (SEQ ID NO:435), gi|33641752 (SEQ ID NO:437), gi|33641714 (SEQ ID NO:438), gi|33641732 (SEQ ID NO:439), gi|33641716 (SEQ ID NO:440), gi|33641720 (SEQ ID NO:441), gi|33641740 (SEQ ID NO:442), gi|14578611 (SEQ ID NO:444), gi|14578615 (SEQ ID NO:445), gi|14578617 (SEQ ID NO:446), gi|29839289 (SEQ ID NO:453), gi|57157826 (SEQ ID NO:455), gi|97974184 (SEQ ID NO:457), gi|24212067 (SEQ ID NO:459), gi|567077 (SEQ ID NO:460), gi|38502831 (SEQ ID NO:463), gi|29839420 (SEQ ID NO:467), gi|125602246 (SEQ ID NO:470), gi|22652500 (SEQ ID NO:473), gi|68159362 (SEQ ID NO:476), gi|4808524 (SEQ ID NO:479), gi|4808522 (SEQ ID NO:480), gi|4808528 (SEQ ID NO:481), gi|4808526 (SEQ ID NO:482), gi|29839258 (SEQ ID NO:483), gi|34398680 (SEQ ID NO:487), gi|51980212 (SEQ ID NO:489), gi|74053618 (SEQ ID NO:490), and gi|32440933 (SEQ ID NO:491).

Amino acid sequences of homologs and/or orthologs of the polypeptide having the amino acid sequence set forth in SEQ ID NO:291 are provided in FIGS. 14A-14F. For example, the alignment in FIGS. 14A-14F provides the amino acid sequences of CeresClone 8049 (SEQ ID NO:291), CeresClone:1365873 (SEQ ID NO:292), gi|1679853 (SEQ ID NO:293), gi|57639629 (SEQ ID NO:294), CeresClone: 538586 (SEQ ID NO:296), gi|68271859 (SEQ ID NO:297), gi|7271916 (SEQ ID NO:300), gi|3023436 (SEQ ID NO:302), CeresAnnot:1514289 (SEQ ID NO:304), gi|684942 (SEQ ID NO:305), gi|1000519 (SEQ ID NO:306), gi|92873946 (SEQ ID NO:307), gi|992610 (SEQ ID NO:308), gi|47680455 (SEQ ID NO:309), gi|13249171 (SEQ ID NO:311), gi|48093469 (SEQ ID NO:312), gi|46394464 (SEQ ID NO:313), gi|24745969 (SEQ ID NO:314), gi|82941443 (SEQ ID NO:315), gi|40795556 (SEQ ID NO:316), gi|5739373 (SEQ ID NO:323), gi|55724835 (SEQ ID NO:324), gi|1934859 (SEQ ID NO:326), gi|6561881 (SEQ ID NO:327), CeresClone: 1605906 (SEQ ID NO:329), gi|30580342 (SEQ ID NO:330), CeresClone:1756603 (SEQ ID NO:332), gi|2995934 (SEQ ID NO:333), CeresClone:700120 (SEQ ID NO:337), gi|96772920 (SEQ ID NO:338), gi|49618875 (SEQ ID NO:339), and gi|4104459 (SEQ ID NO:340).

Other homologs and/or orthologs of SEQ ID NO:291 include Public GI no. 2511737 (SEQ ID NO:295), Ceres CLONE ID no. 541352 (SEQ ID NO:298), Public GI no. 1574946 (SEQ ID NO:317), Public GI no. 1103487 (SEQ ID NO:318), Public GI no. 1575436 (SEQ ID NO:319), Ceres ANNOT ID no. 1441117 (SEQ ID NO:321), Public GI no. 1575440 (SEQ ID NO:322), Public GI no. 1622926 (SEQ ID NO:325), Public GI no. 3319278 (SEQ ID NO:328), Public GI no. 5101868 (SEQ ID NO:334), Ceres CLONE ID no. 353929 (SEQ ID NO:335), and Ceres CLONE ID no. 464460 (SEQ ID NO:336).

In some cases, a lignin-modulating polypeptide can include a polypeptide having at least 80% sequence identity, e.g., 80%, 85%, 90%, 93%, 95%, 97%, 98%, or 99% sequence identity, to an amino acid sequence corresponding to any of SEQ ID NOs:292-298, SEQ ID NO:300, SEQ ID NO:302, SEQ ID NOs:304-309, SEQ ID NOs:311-319, SEQ ID NOs:321-330, SEQ ID NOs:332-340, SEQ ID NOs:378-385, SEQ ID NOs:387-388, SEQ ID NO:390-395, SEQ ID NOs:397-399, SEQ ID NOs:401-407, SEQ ID NOs:409-463, SEQ ID NOs:465-491, SEQ ID NOs:575-577, SEQ ID NOs: 579-581, SEQ ID NO:583, SEQ ID NOs:585-587, SEQ ID NOs:589-590, SEQ ID NO:592, SEQ ID NOs:594-599, SEQ ID NOs:601-617, SEQ ID NO:619, SEQ ID NOs:621-638, SEQ ID NOs:640-672, SEQ ID NO:674, SEQ ID NOs:676-678, SEQ ID NO:680, SEQ ID NOs:682-685, SEQ ID NOs: 687, SEQ ID NO:689, SEQ ID NOs:691-714, SEQ ID NOs: 716-717, SEQ ID NOs:719-737, SEQ ID NO:739, SEQ ID NOs:742-758, or SEQ ID NOs:760-766.

A lignin-modulating polypeptide can contain a Transferase domain characteristic of transferase enzymes. Members of the transferase family of polypeptides include anthranilate N-hydroxycinnamoyl/benzoyltransferase, which catalyzes the first committed reaction of phytoalexin biosynthesis. Another member of the family, deacetylvindoline 4-O-acetyltransferase (EC:2.3.1.107), catalyzes the last step in vindoline biosynthesis. The family also includes trichothecene 3-O-acetyltransferase. SEQ ID NO:240 sets forth the amino acid sequence of a DNA clone, identified herein as Ceres CLONE ID no. 114130 (SEQ ID NO:239), that is predicted to encode a polypeptide containing a Transferase domain.

A lignin-modulating polypeptide can comprise the amino acid sequence set forth in SEQ ID NO:240. In some cases, a lignin-modulating polypeptide can be a homolog, ortholog, or variant of the polypeptide having the amino acid sequence set forth in SEQ ID NO:240. For example, a lignin-modulating polypeptide can have an amino acid sequence with at least 45% sequence identity, e.g., 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:240.

Amino acid sequences of homologs and/or orthologs of the polypeptide having the amino acid sequence set forth SEQ ID NO:240 are provided in FIGS. 12A-12E. For example, the alignment in FIGS. 12A-12E provides the amino acid sequences of CeresClone 114130 (SEQ ID NO:240), CeresClone:1920088 (SEQ ID NO:242), CeresAnnot:1448109 (SEQ ID NO:250), gi|82568711 (SEQ ID NO:257), gi|27475616 (SEQ ID NO:258), CeresClone:660782 (SEQ ID NO:259), gi|50926145 (SEQ ID NO:262), CeresClone: 465877 (SEQ ID NO:263), gi|32400295 (SEQ ID NO:267), CeresClone:741711 (SEQ ID NO:268), CeresClone: 1795778 (SEQ ID NO:270), gi|6469032 (SEQ ID NO:273), gi|40644084 (SEQ ID NO:274), gi|76573303 (SEQ ID NO:275), and gi|3288180 (SEQ ID NO:276). Other homologs and/or orthologs of SEQ ID NO:240 include Ceres CLONE ID no. 1920450 (SEQ ID NO:244), Ceres CLONE ID no. 1941995 (SEQ ID NO:246), Ceres CLONE ID no. 1920870 (SEQ ID NO:248), Ceres ANNOT ID no. 1501106 (SEQ ID NO:252), Ceres ANNOT ID no. 1483635 (SEQ ID NO:254), Ceres ANNOT ID no. 1537107 (SEQ ID NO:256), Ceres CLONE ID no. 1620792 (SEQ ID NO:260), Ceres CLONE ID no. 566887 (SEQ ID NO:261), Public GI no. 50910387 (SEQ ID NO:264), Ceres CLONE ID no. 1598714 (SEQ ID NO:265), Ceres CLONE ID no. 1691303 (SEQ ID NO:266), Public GI no. 32400291 (SEQ ID NO:271), Public GI no. 32400293 (SEQ ID NO:272), Public GI no. 2239091 (SEQ ID NO:277), Public GI no. 2239087 (SEQ ID NO:278), and Public GI no. 2239085 (SEQ ID NO:279).

In some cases, a lignin-modulating polypeptide can include a polypeptide having at least 80% sequence identity, e.g., 80%, 85%, 90%, 93%, 95%, 97%, 98%, or 99% sequence identity, to an amino acid sequence corresponding to any of SEQ ID NO:242, SEQ ID NO:244, SEQ ID NO:246, SEQ ID NO:248, SEQ ID NO:250, SEQ ID NO:252, SEQ ID NO:254, SEQ ID NOs:256-268, and SEQ ID NOs:270-279.

A lignin-modulating polypeptide can contain an Exostosin domain characteristic of the Exostosin (EXT) family of polypeptides. The EXT1 and EXT2 polypeptides are glycosyltransferases having both D-glucuronyl (GlcA) and N-acetyl-D-glucosaminoglycan (GlcNAC) transferase activities. These polypeptides are involved in the chain elongation step of heparan sulphate biosynthesis. SEQ ID NO:183 sets forth the amino acid sequence of a DNA clone, identified herein as Ceres ANNOT ID no. 868753 (SEQ ID NO:182), that is predicted to encode a polypeptide containing an Exostosin domain.

A lignin-modulating polypeptide can comprise the amino acid sequence set forth in SEQ ID NO:183. In some cases, a lignin-modulating polypeptide can be a homolog, ortholog, or variant of the polypeptide having the amino acid sequence set forth in SEQ ID NO:183. For example, a lignin-modulating polypeptide can have an amino acid sequence with at least 55% sequence identity, e.g., 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:183.

Figure 7A:
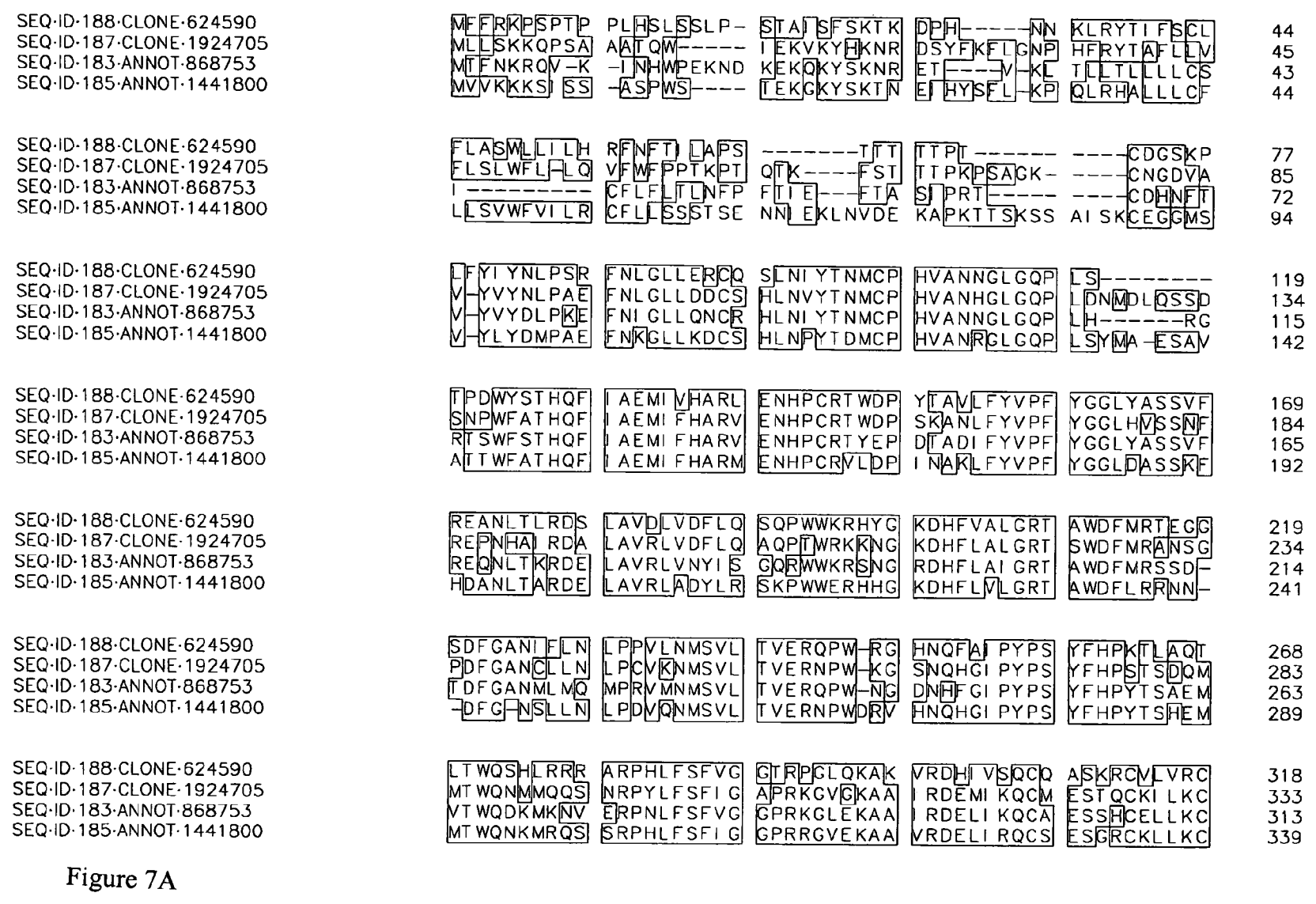

Amino acid sequences of homologs and/or orthologs of the polypeptide having the amino acid sequence set forth in SEQ ID NO:183 are provided in FIGS. 7A-7B. For example, the alignment in FIGS. 7A-7B provides the amino acid sequences of Annot ID 868753 (SEQ ID NO:183), CeresAnnot: 1441800 (SEQ ID NO:185), CeresClone:1924705 (SEQ ID NO:187), and CeresClone:624590 (SEQ ID NO:188).

In some cases, a lignin-modulating polypeptide can include a polypeptide having at least 80% sequence identity, e.g., 80%, 85%, 90%, 93%, 95%, 97%, 98%, or 99% sequence identity, to an amino acid sequence corresponding to any of SEQ ID NO:185, and SEQ ID NOs:187-188.

A lignin-modulating polypeptide can contain a Pollen_allerg_1 domain and a DPBB_1 domain (Rare lipoprotein A (RlpA)-like double-psi beta-barrel fold). A Pollen_allerg_1 domain is characteristic of *Lolium perenne* (perennial rye grass) pollen allergens Lol PI, PII and PIII. A DPBB_1 domain is found in the N-terminus of pollen allergens as well as in some bacterial and eukaryotic lipoproteins, such as RlpA. The DPBB fold is often an enzymatic domain. Pollen allergens share a high degree of sequence similarity with expansins. Expansins are polypeptides that mediate cell wall extension in plants. Expansin polypeptides are believed to act as a chemical grease, allowing polymers to slide past one another by disrupting non-covalent hydrogen bonds that hold many wall polymers to one another. This process is not degradative and does not weaken the wall, which could otherwise rupture under internal pressure during growth. Sequence comparisons indicate at least four distinct expansin cDNAs in rice and at least six in *Arabidopsis*. The polypeptides are highly conserved in size and sequence (75-95% amino acid sequence similarity). It is thought that several highly-conserved tryptophans may function in expansin binding to cellulose, or other glycans. SEQ ID NO:222 and SEQ ID NO:286 set forth the amino acid sequences of DNA clones, identified herein as Ceres CLONE ID no. 108362 (SEQ ID NO:221) and Ceres CLONE ID no. 38915 (SEQ ID NO:285), respectively, each of which is predicted to encode a polypeptide containing a Pollen_allerg_1 domain and a DPBB_1 domain.

A lignin-modulating polypeptide can comprise the amino acid sequence set forth in SEQ ID NO:222 or SEQ ID NO:286. In some cases, a lignin-modulating polypeptide can be a homolog, ortholog, or variant of the polypeptide having the amino acid sequence set forth in SEQ ID NO:222 or SEQ ID NO:286. For example, a lignin-modulating polypeptide can have an amino acid sequence with at least 75% sequence identity, e.g., 75%, 80%, 85%, 90%, 95%, 97%, 98%, or 99% sequence identity, to the amino acid sequence set forth in SEQ ID NO:222 or SEQ ID NO:286.

Amino acid sequences of homologs and/or orthologs of the polypeptide having the amino acid sequence set forth in SEQ ID NO:286 are provided in FIG. 13. For example, the alignment in FIG. 13 provides the amino acid sequences of CeresClone 38915 (SEQ ID NO:286) and CeresClone:1375697 (SEQ ID NO:287).

In some cases, a lignin-modulating polypeptide can include a polypeptide having at least 80% sequence identity, e.g., 80%, 85%, 90%, 93%, 95%, 97%, 98%, or 99% sequence identity, to an amino acid sequence corresponding to SEQ ID NO:287.

A lignin-modulating polypeptide can contain a p450 domain characteristic of a cytochrome P450 polypeptide. The cytochrome P450 enzymes constitute a superfamily of haem-thiolate proteins. P450 enzymes usually act as terminal oxidases in multicomponent electron transfer chains, called P450-containing monooxygenase systems, and are involved in metabolism of a plethora of both exogenous and endogenous compounds. The conserved core is composed of a coil referred to as the "meander," a four-helix bundle, helices J and K, and two sets of beta-sheets. These regions constitute the haem-binding loop (with an absolutely conserved cysteine that serves as the fifth ligand for the haem iron), the proton-transfer groove, and the absolutely conserved EXXR motif in helix K. SEQ ID NO:96, SEQ ID NO:98, and SEQ ID NO:289 set forth the amino acid sequences of DNA clones, identified herein as Ceres ANNOT ID no. 521911 (SEQ ID NO:95), Ceres ANNOT ID no. 535161 (SEQ ID NO:97), and Ceres CLONE ID no. 41046 (SEQ ID NO:288), respectively, each of which is predicted to encode a polypeptide containing a p450 domain.

A lignin-modulating polypeptide can comprise the amino acid sequence set forth in SEQ ID NO:96, SEQ ID NO:98, or SEQ ID NO:289. In some cases, a lignin-modulating polypeptide can be a homolog, ortholog, or variant of the polypeptide having the amino acid sequence set forth in SEQ ID NO:96, SEQ ID NO:98, or SEQ ID NO:289. For example, a lignin-modulating polypeptide can have an amino acid sequence with at least 55% sequence identity, e.g., 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:96, SEQ ID NO:98, or SEQ ID NO:289.

Amino acid sequences of homologs and/or orthologs of the polypeptide having the amino acid sequence set forth in SEQ ID NO:98 are provided in FIGS. 1A-1F. For example, the alignment in FIGS. 1A-1F provides the amino acid sequences of Annot ID 535161 (SEQ ID NO:98), gi|10197650 (SEQ ID NO:101), gi|47933890 (SEQ ID NO:105), gi|85001689 (SEQ ID NO:106), gi|5731998 (SEQ ID NO:107), CeresAnnot:1487764 (SEQ ID NO:109), gi|77744233 (SEQ ID NO:110), gi|46403211 (SEQ ID NO:117), gi|92888952 (SEQ ID NO:118), gi|57470997 (SEQ ID NO:119), gi|5002354 (SEQ ID NO:120), CeresClone:1585325 (SEQ ID NO:121), gi|110289397 (SEQ ID NO:123), and CeresClone:758256 (SEQ ID NO:124). Other homologs and/or orthologs of SEQ ID NO:98 include Public GI no. 12578895 (SEQ ID NO:99), Public GI no. 12578911 (SEQ ID NO:100), Public GI no. 10197652 (SEQ ID NO:102), Public GI no. 10197654 (SEQ ID NO:103), Public GI no. 110432088 (SEQ ID NO:104), Ceres CLONE ID no. 1636607 (SEQ ID NO:111), Public GI no. 6688937 (SEQ ID NO:113), Public GI no. 77744235 (SEQ ID NO:114), Ceres ANNOT ID no. 1457344 (SEQ ID NO:116), and Ceres CLONE ID no. 1600886 (SEQ ID NO:122).

Amino acid sequences of homologs and/or orthologs of the polypeptide having the amino acid sequence set forth in SEQ ID NO:289 are provided in FIG. 22. For example, the alignment in FIG. 1 provides the amino acid sequences of Ceres-Clone 41046 (SEQ ID NO:289), gi|54634694 (SEQ ID NO:816), and gi|38322956 (SEQ ID NO:820).

In some cases, a lignin-modulating polypeptide can include a polypeptide having at least 80% sequence identity, e.g., 80%, 85%, 90%, 93%, 95%, 97%, 98%, or 99% sequence identity, to an amino acid sequence corresponding to any of SEQ ID NOs:99-107, SEQ ID NOs:109-111, SEQ ID NOs:113-114, SEQ ID NOs:116-124, SEQ ID NO:816, or SEQ ID NO:820.

A lignin-modulating polypeptide can have a phytochelatin synthetase-like conserved region (Phytochel_synth domain) characteristic of a family of plant polypeptides believed to be phytochelatin synthetases. Phytochelatin synthetase (EC 2.3.2.15) is a dipeptidyltranspeptidase enzyme responsible for the production of phytochelatins, small glutamic acid, cysteine and glycine-rich peptides. Phytochelatin synthetase catalyzes the synthesis of phytochelatins by transferring a γ-Glu-Cys moiety of glutatlhione to glutathione or to other phytochelatins. SEQ ID NO:196 sets forth the amino acid sequence of a DNA clone, identified herein as Ceres ANNOT ID no. 870466 (SEQ ID NO:195), that is predicted to encode a polypeptide containing a Phytochel_synth domain.

A lignin-modulating polypeptide can comprise the amino acid sequence set forth in SEQ ID NO:196. In some cases, a lignin-modulating polypeptide can be a homolog, ortholog, or variant of the polypeptide having the amino acid sequence set forth in SEQ ID NO:196. For example, a lignin-modulating polypeptide can have an amino acid sequence with at least 60% sequence identity, e.g., 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:196.

Amino acid sequences of homologs and/or orthologs of the polypeptide having the amino acid sequence set forth in SEQ ID NO:196 are provided in FIGS. 8A-8B. For example, the alignment in FIGS. 8A-8B provides the amino acid sequences of Annot ID 870466 (SEQ ID NO:196), gi|90657629 (SEQ ID NO:197), CeresClone:1883580 (SEQ ID NO:199), CeresAnnot:1450185 (SEQ ID NO:201), and gi|50916595 (SEQ ID NO:202).

In some cases, a lignini-modulating polypeptide can include a polypeptide having at least 80% sequence identity, e.g., 80%, 85%, 90%, 93%, 95%, 97%, 98%, or 99% sequence identity, to an amino acid sequence corresponding to any of SEQ ID NO:197, SEQ ID NO:199, and SEQ ID NOs:201-202.

A lignin-modulating polypeptide can contain a Fasciclin domain. The FAS1 or BIgH3 domain is an extracellular module of about 140 amino acid residues. It has been suggested that the FAS1 domain represents an ancient cell adhesion domain common to plants and animals. Related FAS1 domains are also found in bacteria. Most FAS1 domain-containing polypeptides are GPI anchored and contain two or four copies of the domain. FAS1 domains of the BIgH3 polypeptide mediate cell adhesion through an interaction with alpha3/beta1 integrin. A short motif (EPDIM), located on the C-terminal side of the fourth domain, is essential for binding to integrin. The crystal structure of two FAS1 domains (FAS1 3-4) of a fas1 polypeptide have been solved. Each domain comprises a seven-stranded wedge and at least five alpha helices. Two well-ordered N-acetylglucosamine moieties attached to a conserved asparagine are located in the interface region between the two FAS1 domains. The *Arabidopsis* fasciclin-like arabinogalactan polypeptides are examples of FAS1 domain-containing polypeptides. SEQ ID NO:226 sets forth the amino acid sequence of a DNA clone, identified herein as Ceres CLONE ID no. 11114 (SEQ ID NO:225), that is predicted to encode a polypeptide containing a Fasciclin domain.

A lignin-modulating polypeptide can comprise the amino acid sequence set forth SEQ ID NO:226. In some cases, a lignin-modulating polypeptide can be a homolog, ortholog, or variant of the polypeptide having the amino acid sequence set forth in SEQ ID NO:226. For example, a lignin-modulating polypeptide can have an amino acid sequence with at least 45% sequence identity, e.g., 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:226.

Figure 11A:
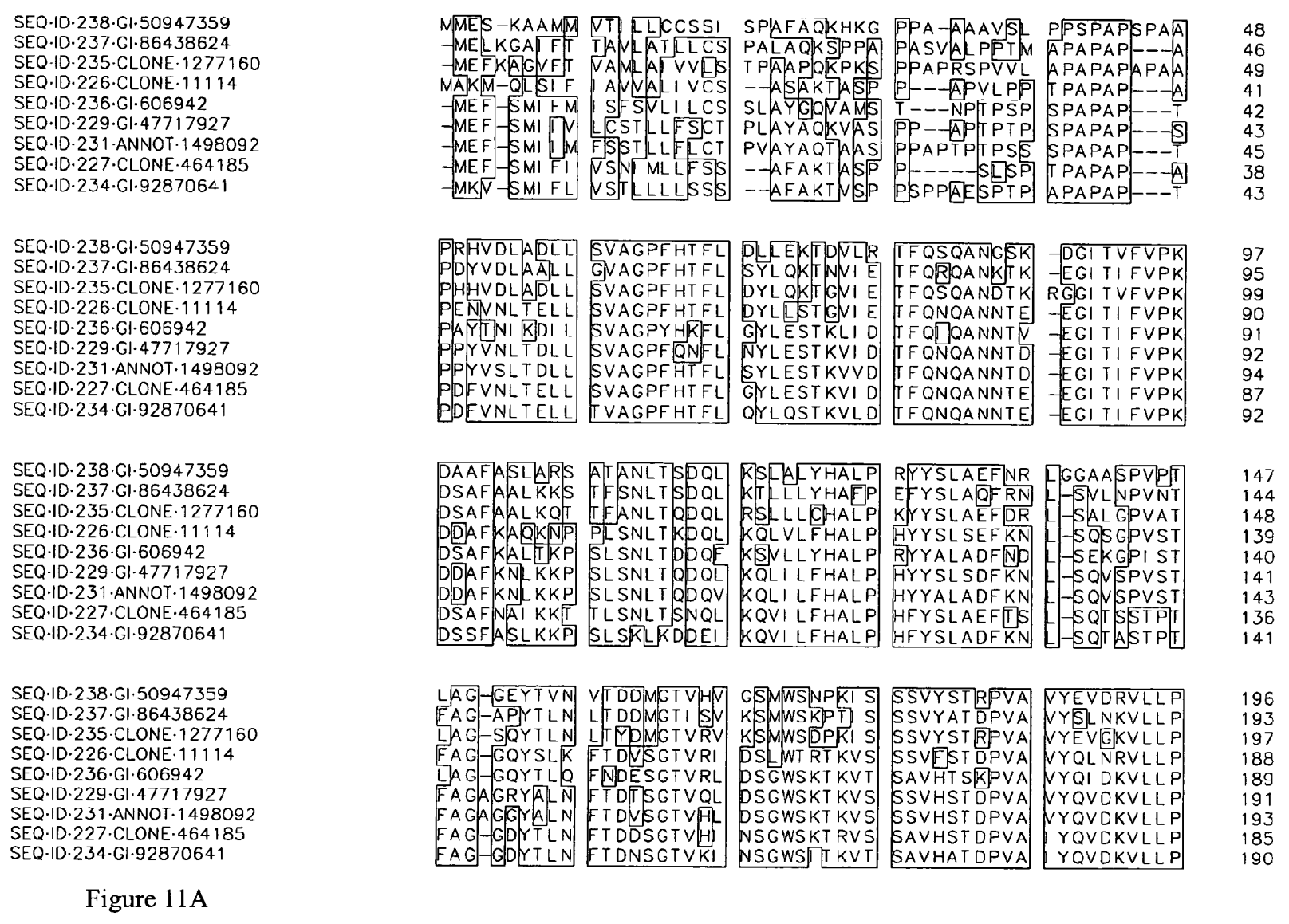
Figure 11B:
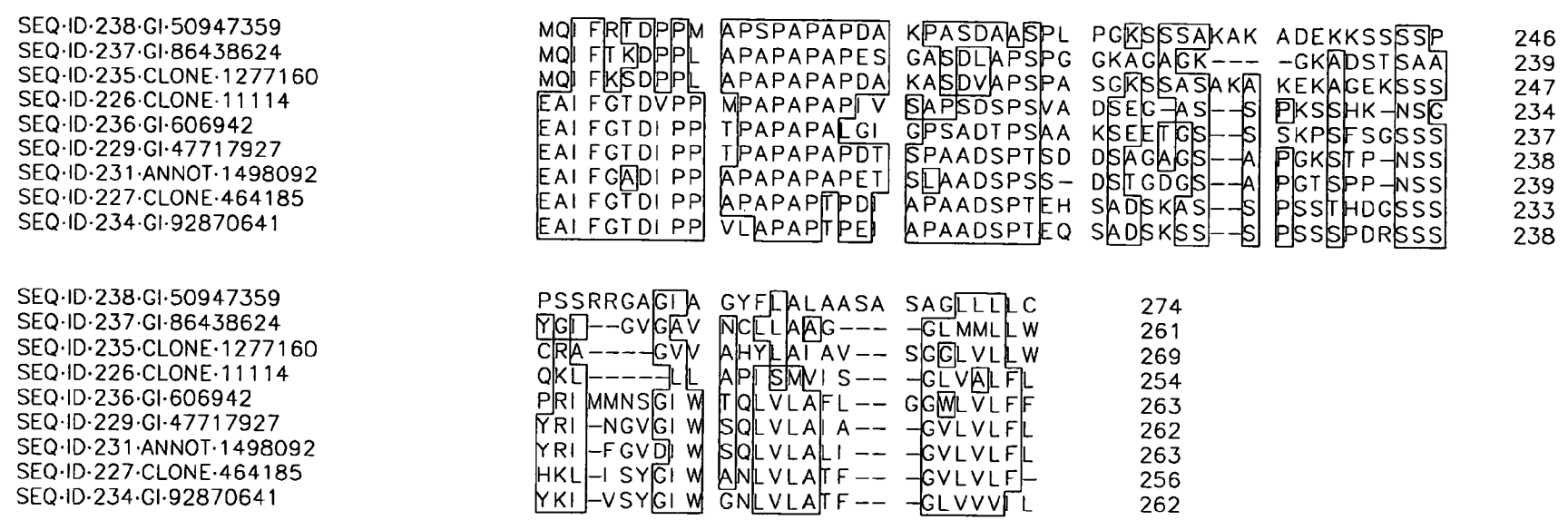

Amino acid sequences of homologs and/or orthologs of the polypeptide having the amino acid sequence set forth in SEQ ID NO:226 are provided in FIGS. 11A-11B. For example, the alignment in FIGS. 11A-11B provides the amino acid sequences of CeresCione 11114 (SEQ ID NO:226), CeresClone:464185 (SEQ ID NO:227), gi|47717927 (SEQ ID NO:229), CeresAnnot:1498092 (SEQ ID NO:231), gi|92870641 (SEQ ID NO:234), CeresClone:1277160 (SEQ ID NO:235), gi|606942 (SEQ ID NO:236), gi|86438624 (SEQ ID NO:237), and gi|50947359 (SEQ ID NO:238). Other homologs and/or orthologs of SEQ ID NO:226 include Ceres ANNOT ID no. 1472093 (SEQ ID NO:233).

In some cases, a lignin-modulating polypeptide can include a polypeptide having at least 80% sequence identity, e.g., 80%, 85%, 90%, 93%, 95%, 97%, 98%, or 99% sequence identity, to an amino acid sequence corresponding to any of SEQ ID NO:227, SEQ ID NO:229, SEQ ID NO:231, or SEQ ID NOs:233-238.

A lignin-modulating polypeptide can contain a myb-like DNA binding domain characteristic of myb-like transcription factor polypeptides. The retroviral oncogene v-myb and its cellular counterpart c-myb encode nuclear DNA binding polypeptides. These polypeptides belong to the SANT domain family that specifically recognize the sequence YAAC(G/T)G. In myb, one of the most conserved regions consisting of three tandem repeats has been shown to be involved in DNA binding. *Arabidopsis thaliana* is estimated to contain more than 140 MYB or MYB-related genes. In contrast to animals, plants contain a MYB-protein subfamily that is characterized by the R2R3-type MYB domain. Classical MYB factors, which are related to c-MYB, seem to be involved in the control of the cell cycle in animals, plants and other higher eukaryotes. R2R3-type MYB genes control many aspects of plant secondary metabolism, as well as the identity and fate of plant cells. SEQ ID NO:134, SEQ ID NO:216, and SEQ ID NO:342 set forth the amino acid sequences of DNA clones, identified herein as Ceres ANNOT ID no. 858797 (SEQ ID NO:133), Ceres CLONE ID no. 1006105 (SEQ ID NO:215), and Ceres LOCUS ID no. 1461478 (SEQ ID NO:341), respectively, each of which is predicted to encode a polypeptide containing a myb-like DNA binding domain.

A lignin-modulating polypeptide can comprise the amino acid sequence set forth in SEQ ID NO:134, SEQ ID NO:216, or SEQ ID NO:342. In some cases, a lignin-modulating polypeptide can be a homolog, ortholog, or variant of the polypeptide having the amino acid sequence set forth in SEQ ID NO:134, SEQ ID NO:216, or SEQ ID NO:342. For example, a lignin-modulating polypeptide can have an amino acid sequence with at least 40% sequence identity, e.g., 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:134, SEQ ID NO:216, or SEQ ID NO:342.

Amino acid sequences of homologs and/or orthologs of the polypeptide having the amino acid sequence set forth in SEQ ID NO:134 and SEQ ID NO:342 are provided in FIGS. 15A-15G and FIGS. 18A-18E, respectively. For example, the alignment in FIGS. 15A-15G provides the amino acid sequences of Annot. ID 858797 (SEQ ID NO:134), gi|147744710 (SEQ ID NO:492), gi|89058600 (SEQ ID NO:494), gi|124430478 (SEQ ID NO:495), CeresClone 1836832 (SEQ ID NO:498), gi|83638483 (SEQ ID NO:503), Annot. ID 460633 (SEQ ID NO:505), Annot. ID 1471346 (SEQ ID NO:507), gi|119720796 (SEQ ID NO:508), gi|110931646 (SEQ ID NO:509), gi|92878899 (SEQ ID NO:514), gi|1841475 (SEQ ID NO:515), gi|39725415 (SEQ ID NO:516), gi|1167484 (SEQ ID NO:517), gi|126653935 (SEQ ID NO:518), gi|6552361 (SEQ ID NO:519), gi|126567773 (SEQ ID NO:521), gi|66736124 (SEQ ID NO:530), gi|145306631 (SEQ ID NO:531), gi|75107028 (SEQ ID NO:532), gi|127579 (SEQ ID NO:533), gi|38707418 (SEQ ID NO:534), gi|2605617 (SEQ ID NO:536), gi|38707432 (SEQ ID NO:538), gi|125487106 (SEQ ID NO:539), CeresClone 764797 (SEQ ID NO:542), CeresClone 1418548 (SEQ ID NO:544), gi|51872289 (SEQ ID NO:546), gi|119220854 (SEQ ID NO:547), gi|101919348 (SEQ ID NO:548), gi|125562458 (SEQ ID NO:549), gi|19072766 (SEQ ID NO:552), gi|76789657 (SEQ ID NO:560), gi|41581480 (SEQ ID NO:563), gi|148524147 (SEQ ID NO:564), gi|22266673 (SEQ ID NO:565), gi|19055 (SEQ ID NO:567), gi|23307803 (SEQ ID NO:568), gi|126567771 (SEQ ID NO:569), gi|28628961 (SEQ ID NO:570), gi|29824962 (SEQ ID NO:571), gi|42541177 (SEQ ID NO:572), and gi|148524145 (SEQ ID NO:574).

Other homologs and/or orthologs of SEQ ID NO:134 include gi|147744720 (SEQ ID NO:493), gi|13346194 (SEQ ID NO:496), gi|23476279 (SEQ ID NO:499), gi|437327 (SEQ ID NO:500), gi|1976145 (SEQ ID NO:502), gi|114384137 (SEQ ID NO:510), gi|10931806 (SEQ ID NO:511), CeresClone 1642529 (SEQ ID NO:513), gi|1732247 (SEQ ID NO:520), gi|126567788 (SEQ ID NO:522), gi|126567775 (SEQ ID NO:523), gi|7673088 (SEQ ID NO:524), gi|126567782 (SEQ ID NO:525), gi|126567786 (SEQ ID NO:526), gi|126567784 (SEQ ID NO:527), gi|7673086 (SEQ ID NO:528), gi|61696099 (SEQ ID NO:529), gi|38707422 (SEQ ID NO:535), gi|2605619 (SEQ ID NO:537), gi|47680445 (SEQ ID NO:540), gi|89143143 (SEQ ID NO:545), gi|125562456 (SEQ ID NO:550), gi|125533629 (SEQ ID NO:551), gi|115477685 (SEQ ID NO:553), gi|115484469 (SEQ ID NO:554), gi|125594329 (SEQ ID NO:555), gi|55733916 (SEQ ID NO:556), gi|125576429 (SEQ ID NO:557), gi|115441355 (SEQ ID NO:558), gi|77553801 (SEQ ID NO:559), gi|89258177 (SEQ ID NO:561), gi|89258179 (SEQ ID NO:562), gi|22266675 (SEQ ID NO:566), and gi|42541167 (SEQ ID NO:573).

The alignment in FIGS. 18A-18E provides the amino acid sequences of Annot ID 1461478 (SEQ ID NO:342), gi|146217453 (SEQ ID NO:355), gi|34147924 (SEQ ID NO:356), Annot ID 1440199 (SEQ ID NO:358), gi|116831188 (SEQ ID NO:359), gi|71041096 (SEQ ID NO:363), gi|92891589 (SEQ ID NO:364), gi|39725413 (SEQ ID NO:365), gi|33320067 (SEQ ID NO:366), gi|1167486 (SEQ ID NO:367), gi|1002798 (SEQ ID NO:368), gi|547958 (SEQ ID NO:369), CeresClone 851672 (SEQ ID NO:371), CeresClone 1711992 (SEQ ID NO:373), gi|30024600 (SEQ ID NO:374), gi|11526775 (SEQ ID NO:375), gi|22795039 (SEQ ID NO:376), and gi|30575840 (SEQ ID NO:377). Other homologs and/or orthologs of SEQ ID NO:342 include gi|15231922 (SEQ ID NO:360), gi|51970238 (SEQ ID NO:361), and gi|45357090 (SEQ ID NO:362).

In some cases, a lignin-modulating polypeptide can include a polypeptide having at least 80% sequence identity, e.g., 80%, 85%, 90%, 93%, 95%, 97%, 98%, or 99% sequence identity, to an amino acid sequence corresponding to any of SEQ ID NO:342, SEQ ID NOs:355-356, SEQ ID NOs:358-369, SEQ ID NO:371, SEQ ID NOs:373-377, SEQ ID NOs:492-496, SEQ ID NOs:498-500, SEQ ID NOs:502-503, SEQ ID NO:505, SEQ ID NOs:507-511, SEQ ID NOs: 513-540, or SEQ ID NOs:544-574.

A lignin-modulating polypeptide can have a NAM domain characteristic of a No apical meristem (NAM) polypeptide. No apical meristem (NAM) polypeptides are plant development polypeptides. NAM is indicated as having a role in determining positions of meristems and primordia. The NAC domain (NAM for *Petunia hybrida* and ATAF1, ATAF2, and CUC2 for *Arabidopsis*) is an N-terminal module of about 160 amino acids, which is found in polypeptides of the NAC family of plant-specific transcriptional regulators (no apical meristem polypeptides). NAC proteins are involved in developmental processes, including formation of the shoot apical meristem, floral organs and lateral shoots, as well as in plant hormonal control and defense. The NAC domain is accompanied by diverse C-terminal transcriptional activation domains. The NAC domain has been shown to be a DNA-binding domain and a dimerization domain. SEQ ID NO:284 sets forth the amino acid sequence of a DNA clone, identified herein as Ceres CLONE ID no. 21243 (SEQ ID NO:283), which is predicted to encode a polypeptide containing a NAM domain.

A lignin-modulating polypeptide can comprise the amino acid sequence set forth in SEQ ID NO:284. In some cases, a lignin-modulating polypeptide can be a homolog, ortholog, or variant of the polypeptide having the amino acid sequence set forth in SEQ ID NO:284. For example, a lignin-modulating polypeptide can have an amino acid sequence with at least 40% sequence identity, e.g., 45%, 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:284.

Amino acid sequences of homologs and/or orthologs of the polypeptide having the amino acid sequence set forth in SEQ ID NO:284 are provided in FIGS. 21A-21I. For example, the alignment in FIGS. 21A-21I provides the amino acid sequences of CeresClone 21243 (SEQ ID NO:284), CeresClone 1848247 (SEQ ID NO:788), gi|20466640 (SEQ ID NO:789), gi|31322578 (SEQ ID NO:790), gi|63252923 (SEQ ID NO:792), CeresClone 467981 (SEQ ID NO:794), gi|87241197 (SEQ ID NO:795), gi|57233056 (SEQ ID NO:796), gi|52353036 (SEQ ID NO:797), gi|21105748 (SEQ ID NO:798), gi|6730938 (SEQ ID NO:799), gi|58013003 (SEQ ID NO:800), gi|66275774 (SEQ ID NO:801), gi|15336267 (SEQ ID NO:804), gi|117586720 (SEQ ID NO:805), gi|73759951 (SEQ ID NO:806), gi|115336269 (SEQ ID NO:807), CeresClone 1824711 (SEQ ID NO:809), gi|82400207 (SEQ ID NO:810), gi|154362215 (SEQ ID NO:813), gi|78499704 (SEQ ID NO:814), and gi|82568708 (SEQ ID NO:815). Other homologs and/or orthologs of SEQ ID NO:284 include gi|31322576 (SEQ ID NO:791), gi|66275772 (SEQ ID NO:802), gi|51702424 (SEQ ID NO:803), gi|82400213 (SEQ ID NO:811), and gi|82400209 (SEQ ID NO:812).

In some cases, a lignin-modulating polypeptide can include a polypeptide having at least 80% sequence identity, e.g., 80%, 85%, 90%, 93%, 95%, 97%, 98%, or 99% sequence identity, to an amino acid sequence corresponding to any of SEQ ID NOs:788-792, SEQ ID NOs:794-807, and SEQ ID NOs:809-815.

A lignin-modulating polypeptide can have one or more domains characteristic of a homeobox polypeptide. For example, a lignin-modulating polypeptide can contain a homeobox domain, a HALZ domain, and an HD-ZIP_N domain. The homeobox domain is involved in DNA binding through a helix-turn-helix (HTH) structure. The HTH motif is characterized by two alpha-helices, which make intimate contacts with DNA and are joined by a short turn. Examples of homeodomain-containing polypeptides include transcriptional regulators encoded by hox genes that operate differential genetic programs along the anterior-posterior axis of animal bodies. The homeobox associated leucine zipper (HALZ) domain is a plant specific leucine zipper that is associated with a homeobox. The HD-ZIP_N domain is characteristic of the N-termini of plant homeobox-leucine zipper polypeptides. Homeodomain leucine zipper (HDZip) genes encode putative transcription factors that are unique to plants. This observation suggests that homeobox-leucine zipper genes evolved after the divergence of plants and animals, perhaps to mediate specific regulatory events. SEQ ID NO:218 sets forth the amino acid sequence of a DNA clone, identified herein as Ceres CLONE ID no. 1014844 (SEQ ID NO:217), which is predicted to encode a polypeptide having a homeobox domain, a HALZ domain, and an HD-ZIP_N domain.

A lignin-modulating polypeptide can comprise the amino acid sequence set forth in SEQ ID NO:218. In some cases, a lignin-modulating polypeptide can be a homolog, ortholog, or variant of the polypeptide having the amino acid sequence set forth in SEQ ID NO:218. For example, a lignin-modulating polypeptide can have an amino acid sequence with at least 80% sequence identity, e.g., 80%, 85%, 90%, 95%, 97%, 98%, or 99% sequence identity, to the amino acid sequence set forth in SEQ ID NO:218.

Amino acid sequences of homologs and/or orthologs of the polypeptide having the amino acid sequence set forth SEQ ID NO:218 are provided in FIG. 10. For example, the alignment in FIG. 10 provides the amino acid sequences of CeresClone 1014844 (SEQ ID NO:218) and gi|89257493 (SEQ ID NO:220). Other homologs and/or orthologs of SEQ ID NO:218 include Ceres CLONE ID no. 26013 (SEQ ID NO:219).

In some cases, a lignin-modulating polypeptide can include a polypeptide having at least 80% sequence identity, e.g., 80%, 85%, 90%, 93%, 95%, 97%, 98%, or 99% sequence identity, to an amino acid sequence corresponding to any of SEQ ID NOs:219-220.

SEQ ID NO:176 sets forth the amino acid sequence of a DNA clone, identified herein as Ceres ANNOT ID no. 867623 (SEQ ID NO:175), which is predicted to encode a polypeptide that does not have homology to an existing polypeptide family based on Pfam analysis. A lignin-modulating polypeptide can comprise the amino acid sequence set forth in SEQ ID NO:176. In some cases, a lignin-modulating polypeptide can be a homolog, ortholog, or variant of the polypeptide having the amino acid sequence set forth in SEQ ID NO:176. For example, a lignin-modulating polypeptide can have an amino acid sequence with at least 45% sequence identity, e.g., 47%, 48%, 49%, 50%, 51%, 52%, 56%, 57%, 60%, 61%, 62%, 63%, 64%, 65%, 67%, 68%, 70%, 75%, 80%, 85%, 90%, 95%, 97%, 98%, or 99% sequence identity, to the amino acid sequence set forth in SEQ ID NO:176.

Amino acid sequences of homologs and/or orthologs of the polypeptide having the amino acid sequence set forth SEQ ID NO:176 are provided in FIG. 6. For example, the alignment in FIG. 6 provides the amino acid sequences of Annot ID 867623 (SEQ ID NO:176), CeresClone:873156 (SEQ ID NO:177), gi|83032230 (SEQ ID NO:178), CeresClone: 1121732 (SEQ ID NO:180), and gi|92881787 (SEQ ID NO:181). Other homologs and/or orthologs of SEQ ID NO:176 include Ceres CLONE ID no. 971850 (SEQ ID NO:179).

In some cases, a lignin-modulating polypeptide can include a polypeptide having at least 80% sequence identity, e.g., 80%, 85%, 90%, 93%, 95%, 97%, 98%, or 99% sequence identity, to an amino acid sequence corresponding to any of SEQ ID NOs:177-181.

SEQ ID NO:126 sets forth the amino acid sequence of a DNA clone, identified herein as Ceres ANNOT ID no. 837136 (SEQ ID NO:125), that is predicted to encode a polypeptide that does not have homology to an existing polypeptide family based on Pfam analysis. A lignin-modulating polypeptide can comprise the amino acid sequence set forth in SEQ ID NO:126. In some cases, a lignin-modulating polypeptide can be a homolog, ortholog, or variant of the polypeptide having the amino acid sequence set forth in SEQ ID NO:126. For example, a regulatory polypeptide can have an amino acid sequence with at least 50% sequence identity, e.g., 50%, 55%, 60%, 65%, 70%, 75%, 80%, 85%, 90%, 95%, 97%, 98%, or 99% sequence identity, to the amino acid sequence set forth in SEQ ID NO:126.

Figure 2A:
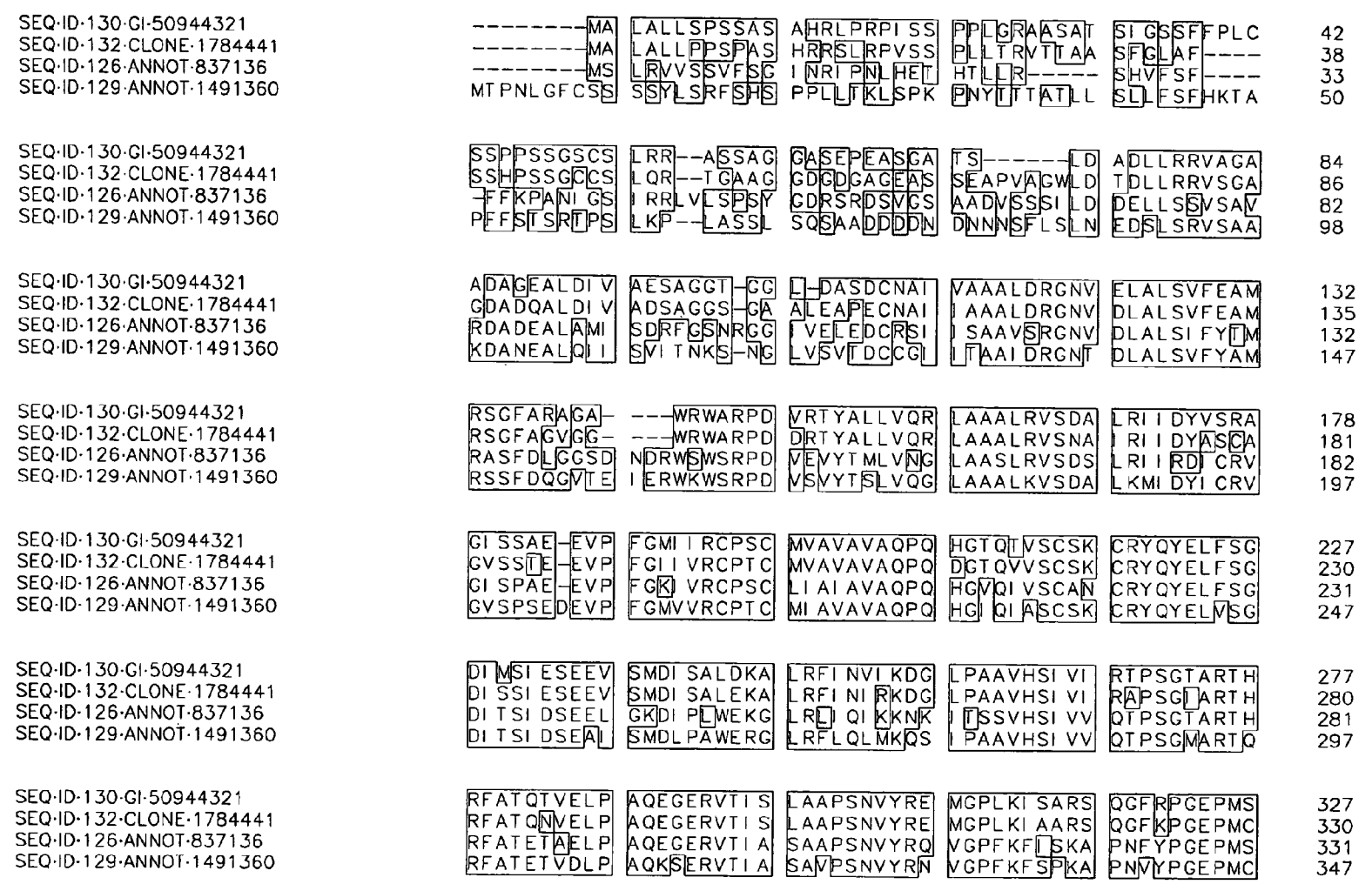

Amino acid sequences of homologs and/or orthologs of the polypeptide having the amino acid sequence set forth in SEQ ID NO:126 are provided in FIGS. 2A-2B. For example, the alignment in FIGS. 2A-2B provides the amino acid sequences of Annot ID 837136 (SEQ ID NO:126), CeresAnnot: 1491360 (SEQ ID NO:129), gi|50944321 (SEQ ID NO:130), and CeresClone:1784441 (SEQ ID NO:132). Other homologs and/or orthologs of SEQ ID NO:126 include Public GI no. 12323467 (SEQ ID NO:127).

In some cases, a lignin-modulating polypeptide can include a polypeptide having at least 80% sequence identity, e.g., 80%, 85%, 90%, 93%, 95%, 97%, 98%, or 99% sequence identity, to an amino acid sequence corresponding to any of SEQ ID NO:127, SEQ ID NOs:129-130, or SEQ ID NO:132.

A lignin-modulating polypeptide encoded by a recombinant nucleic acid can be a native lignin-modulating polypeptide, i.e., one or more additional copies of the coding sequence for a lignin-modulating polypeptide that is naturally present in the cell. Alternatively, a lignin-modulating polypeptide can be heterologous to the cell, e.g., a transgenic *Populus* plant can contain the coding sequence for an enzyme from an *Arabidopsis* plant.

A lignin-modulating polypeptide can include additional amino acids that are not involved in modulating gene expression, and thus can be longer than would otherwise be the case. For example, a lignin-modulating polypeptide can include an amino acid sequence that functions as a reporter. Such a lignin-modulating polypeptide can be a fusion protein in which a green fluorescent protein (GFP) polypeptide is fused to, e.g., SEQ ID NO:96, or in which a yellow fluorescent protein (YFP) polypeptide is fused to, e.g., SEQ ID NO:98. In some embodiments, a lignin-modulating polypeptide includes a purification tag, a chloroplast transit peptide, a mitochondrial transit peptide, an amyloplast peptide, or a leader sequence added to the amino or carboxyl terminus.

In some embodiments, one or more functional homologs of a reference lignin-modulating polypeptide defined by one or more of the pfam descriptions indicated above are suitable for use as lignin-modulating polypeptides. A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, may themselves be functional homologs. Functional homologs can also be created via site-directed mutagenesis of the coding sequence for a lignin-modulating polypeptide, or by combining domains from the coding sequences for different naturally-occurring lignin-modulating polypeptides ("domain swapping"). The term "functional homolog" is sometimes applied to the nucleic acid that encodes a functionally homologous polypeptide.

Lignin-modulating polypeptide candidates suitable for use in the invention can be identified by analysis of nucleotide and polypeptide sequence alignments. For example, performing a query on a database of nucleotide or polypeptide sequences can identify homologs and/or orthologs of lignin-modulating polypeptides. Sequence analysis can involve BLAST, Reciprocal BLAST, or PSI-BLAST analysis of nonredundant databases using known lignin-modulating polypeptide amino acid sequences. Those polypeptides in the database that have greater than 40% sequence identity can be identified as candidates for further evaluation for suitability as lignin-modulating polypeptides. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains suspected of being present in lignin-modulating polypeptides, e.g., conserved functional domains.

The identification of conserved regions in a template or subject polypeptide can facilitate production of variants of lignin-modulating polypeptides. Conserved regions can be identified by locating a region within the primary amino acid sequence of a template polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains at sanger.ac.uk/Pfam and genome.wustl.edu/Pfam. A description of the information included at the Pfam database is described in Sonnhammer et al., *Nucl. Acids Res.,* 26:320-322 (1998); Sonnhammer et al., *Proteins,* 28:405-420 (1997); and Bateman et al., *Nucl. Acids Res.,* 27:260-262 (1999). Amino acid residues corresponding to Pfam domains included in lignin-modulating polypeptides provided herein are set forth in the sequence listing. For example, amino acid residues 30 to 89 of the amino acid sequence set forth in SEQ ID NO:190 correspond to a dimerisation domain, as indicated in fields <222> and <223> for SEQ ID NO:190 in the sequence listing.

Conserved regions also can be determined by aligning sequences of the same or related polypeptides from closely related species. Closely related species preferably are from the same family. In some embodiments, alignment of sequences from two different species is adequate. For example, sequences from *Arabidopsis thaliana* and *Glycine max* can be used to identify one or more conserved regions.

Typically, polypeptides that exhibit at least about 40% amino acid sequence identity are useful to identify conserved regions. Conserved regions of related polypeptides can exhibit at least 45% amino acid sequence identity, e.g., at least 50%, at least 60%, at least 70%, at least 80%, or at least 90% amino acid sequence identity. In some embodiments, a conserved region of target and template polypeptides exhibit at least 92%, 94%, 96%, 98%, or 99% amino acid sequence identity. Amino acid sequence identity can be deduced from amino acid or nucleotide sequences. In certain cases, highly conserved domains have been identified within lignin-modulating polypeptides. These conserved regions can be useful in identifying functionally similar (orthologus) lignin-modulating polypeptides.

In some instances, suitable lignin-modulating polypeptides can be synthesized on the basis of functional domains and/or conserved regions in polypeptides that are homologous lignin-modulating polypeptides. Domains are groups of substantially contiguous amino acids in a polypeptide that can be used to characterize protein families and/or parts of proteins. Such domains have a "fingerprint" or "signature" that can comprise conserved (1) primary sequence, (2) secondary structure, and/or (3) three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

Representative homologs and/or orthologs of lignin-modulating polypeptides are shown in FIGS. 1-22. Each Figure represents an alignment of the amino acid sequence of a lignin-modulating polypeptide with the amino acid sequences of corresponding homologs and/or orthologs. Amino acid sequences of lignin-modulating polypeptides and their corresponding homologs and/or orthologs have been aligned to identify conserved amino acids as shown in FIGS. 1-22. A dash in an aligned sequence represents a gap, i.e., a lack of an amino acid at that position. Identical amino acids or conserved amino acid substitutions among aligned sequences are identified by boxes.

The identification of conserved regions in a lignin-modulating polypeptide facilitates production of variants of lignin-modulating polypeptides. Variants of lignin-modulating polypeptides typically have 10 or fewer conservative amino acid substitutions within the primary amino acid sequence, e.g., 7 or fewer conservative amino acid substitutions, 5 or fewer conservative amino acid substitutions, or between 1 and 5 conservative substitutions. Useful variant polypeptides can be constructed based on the conserved regions in FIG. 1, FIG. 2, FIG. 3, FIG. 4, FIG. 5, FIG. 6, FIG. 7, FIG. 8, FIG. 9, FIG. 10, FIG. 11, FIG. 12, FIG. 13, FIG. 14, FIG. 15, FIG. 16, FIG. 17, FIG. 18, FIG. 19, FIG. 20, FIG. 21, or FIG. 22. Such a polypeptide includes the conserved regions arranged in the order depicted in a Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at all positions marked by dashes, such a polypeptide has a length that is the sum of the amino acid residues in all conserved regions and all dashes.

A conserved domain in certain cases may be a localization domain, an activation domain, a repression domain, an oligomerization domain, a catalytic domain, or a DNA binding domain. Consensus domains and conserved regions can be identified by homologous polypeptide sequence analysis as described above. The suitability of polypeptides for use as lignin-modulating polypeptides can be evaluated by functional complementation studies.

A lignin-modulating polypeptide also can be a fragment of a naturally occurring lignin-modulating polypeptide. In certain cases, such as transcription factor lignin-modulating polypeptides, a fragment can comprise the DNA-binding and transcription-regulating domains of the naturally occurring lignin-modulating polypeptide. In some cases, such as enzyme lignin-modulating polypeptides, a fragment can comprise the catalytic domain of the naturally occurring lignin-modulating polypeptide.

Useful lignin-modulating polypeptides also can include those that fit a Hidden Markov Model based on the polypeptides set forth in any one of FIGS. 1-22. A Hidden Markov Model (HMM) is a statistical model of a consensus sequence for a group of functional homologs. See, Durbin et al., *Biological Sequence Analysis: Probabilistic Models of Proteins and Nucleic Acids*, Cambridge University Press, Cambridge, UK (1998). An HMM is generated by the program HMMER 2.3.2 with default program parameters, using the sequences of the group of functional homologs as input. The multiple sequence alignment is generated by ProbCons (Do et al., Genome Res., 15(2):330-40 (2005)) version 1.11 using a set of default parameters: —c, —consistency REPS of 2; —ir, —iterative-refinement REPS of 100; —pre, —pre-training REPS of 0. ProbCons is a public domain software program provided by Stanford University.

The default parameters for building an HMM (hmmbuild) are as follows: the default "architecture prior" (archpri) used by MAP architecture construction is 0.85, and the default cutoff threshold (idlevel) used to determine the effective sequence number is 0.62. HMMER 2.3.2 was released Oct. 3, 2003 under a GNU general public license, and is available from various sources on the World Wide Web such as hmmer.janelia.org; hmmer.wustl.edu; and fr.com/hmmer232/. Hmmbuild outputs the model as a text file.

The HMM for a group of functional homologs can be used to determine the likelihood that a candidate lignin-modulating polypeptide sequence is a better fit to that particular HMM than to a null HMM generated using a group of sequences that are not structurally or functionally related. The likelihood that a candidate polypeptide sequence is a better fit to an HMM than to a null HMM is indicated by the HMM bit score, a number generated when the candidate sequence is fitted to the HMM profile using the HMMER hmmsearch program. The following default parameters are used when running hmmsearch: the default E-value cutoff (E) is 10.0, the default bit score cutoff (T) is negative infinity, the default number of sequences in a database (Z) is the real number of sequences in the database, the default E-value cutoff for the per-domain ranked hit list (domE) is infinity, and the default bit score cutoff for the per-domain ranked hit list (domT) is negative infinity. A high HMM bit score indicates a greater likelihood that the candidate sequence carries out one or more of the biochemical or physiological function(s) of the polypeptides used to generate the HMM. A high HMM bit score is at least 20, and often is higher. Slight variations in the HMM bit score of a particular sequence can occur due to factors such as the order in which sequences are processed for alignment by multiple sequence alignment algorithms such as the ProbCons program. Nevertheless, such HMM bit score variation is minor.

The lignin-modulating polypeptides discussed herein fit the indicated HMM with an HMM bit score greater than 20 (e.g., greater than 30, 40, 50, 60, 70, 80, 90, 100, 200, 300, 400, or 500). In some embodiments, the HMM bit score of a lignin-modulating polypeptide discussed below is about 50%, 60%, 70%, 80%, 90%, or 95% of the HMM bit score of a functional homolog provided in one of FIGS. 1-22. In some embodiments, a lignin-modulating polypeptide discussed herein fits the indicated HMM with an HMM bit score greater than 20, and has a conserved domain e.g., a PFAM domain, or a conserved region having 70% or greater sequence identity (e.g., 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity) to a conserved domain or region present in a lignin-modulating polypeptide disclosed herein. In some embodiments, a lignin-modulating polypeptide discussed herein fits the indicated HMM with an HMM bit score greater than 20, and can have a conserved domain, e.g., a PFAM domain, or a conserved region having 70% or greater sequence identity (e.g., 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity) to a conserved domain or region present in a lignin-modulating polypeptide disclosed herein.

For example, a lignin-modulating polypeptide can fit an HMM generated using the amino acid sequences set forth in FIG. 1 with an HMM bit score that is greater than about 1100 (e.g., greater than about 1125, 1150, 1200, 1230, or 1250). In some cases, a protein-modulating polypeptide can fit an HMM generated using the amino acid sequences set forth in FIG. 2 with an HMM bit score that is greater than about 1275 (e.g., greater than about 1300, 1350, 1400, 1450, 1500, 1550, 1600, or 1650). In some cases, a lignin-modulating polypeptide can fit an HMM generated using the amino acid sequences set forth in FIG. 3 with an HMM bit score that is greater than about 1175 (e.g., greater than about 1200, 1225, 1250, or 1275). In some cases, a lignin-modulating polypeptide can fit an HMM generated using the amino acid sequences set forth in FIG. 4 with an HMM bit score that is greater than about 400 (e.g., greater than about 425, 450, 500, 550, 600, 650, 700, or 750). In some cases, a lignin-modulating polypeptide can fit an HMM generated using the amino acid sequences set forth in FIG. 5 with an HMM bit score that is greater than about 1000 (e.g., greater than about 1025, 1050, 1100, 1150, 1200, or 1250). In some cases, a lignin-modulating polypeptide can fit an HMM generated using the amino acid sequences set forth in FIG. 6 with an HMM bit score that is greater than about 120 (e.g., greater than about 125, 130, or 135). In some cases, a lignin-modulating polypeptide can fit an HMM generated using the amino acid sequences set forth in FIG. 7 with an HMM bit score that is greater than about 1375 (e.g., greater than about 1400, 1450, 1500, or 1520). In some cases, a lignin-modulating polypeptide can fit an HMM generated using the amino acid sequences set forth in FIG. 8 with an HMM bit score that is greater than about 1100 (e.g., greater than about 1125, 1150, 1200, or 1225). In some cases, a lignin-modulating polypeptide can fit an HMM generated using the amino acid sequences set forth in FIG. 9 with an HMM bit score that is greater than about 700 (e.g., greater than about 710, 725, 750, 775, 800, 810, or 825). In some cases, a lignin-modulating polypeptide can fit an HMM generated using the amino acid sequences set forth in FIG. 10 with an HMM bit score that is greater than about 825 (e.g., greater than about 830, 840, 850, or 860). In some cases, a lignin-modulating polypeptide can fit an HMM generated using the amino acid sequences set forth in FIG. 11 with an HMM bit score that is greater than about 530 (e.g., greater than about 540, 550, 575, or 600). In some cases, a lignin-modulating polypeptide can fit an HMM generated using the amino acid sequences set forth in FIG. 12 with an HMM bit score that is greater than about 900 (e.g., greater than about 910, 925, 950, 1000, 1050, 1100, or 1150). In some cases, a lignin-modulating polypeptide can fit an HMM generated using the amino acid sequences set forth in FIG. 13 with an HMM bit score that is greater than about 460 (e.g., greater than about 475, 500, 510, or 520). In some cases, a lignin-modulating polypeptide can fit an HMM generated using the amino acid sequences set forth in FIG. 14 with an HMM bit score that is greater than about 600 (e.g., greater than about 610, 625, 650, 660, 675, or 685). In some cases, a lignin-modulating polypeptide can fit an HMM generated using the amino acid sequences set forth in FIG. 15 with an HMM bit score that is greater than about 180 (e.g., greater than about 185, 190, 200, 225, 250, 275, 300, 325, 350, 375, 400, 425, 500, 525, 550, 1150, 1200, or 1250). In some cases, a lignin-modulating polypeptide can fit an HMM generated using the amino acid sequences set forth in FIG. 16 with an HMM bit score that is greater than about 575 (e.g., greater than about 600, 650, 700, 750, 800, 850, 900, 950, 1000, 1050, or 1100). In some cases, a lignin-modulating polypeptide can fit an HMM generated using the amino acid sequences set forth in FIG. 17 with an HMM bit score that is greater than about 85 (e.g., greater than about 100, 200, 300, 400, 450, 500, 600, 650, 700, 750, 800, 850, 900, 950, 1000, or 1050). In some cases, a lignin-modulating polypeptide can fit an HMM generated using the amino acid sequences set forth in FIG. 18 with an HMM bit score that is greater than about 150 (e.g., greater than about 200, 250, 300, 350, 400, 450, 500, 550, or 600). In some cases, a lignin-modulating polypeptide can fit an HMM generated using the amino acid sequences set forth in FIG. 19 with an HMM bit score that is greater than about 375 (e.g., greater than about 400, 425, 450, 475, 500, 525, 550, 575, 600, 650, 700, 750, 800, 850, 900, 950, 1000, or 1050). In some cases, a lignin-modulating polypeptide can fit an HMM generated using the amino acid sequences set forth in FIG. 20 with an HMM bit score that is greater than about 700 (e.g., greater than about 710, 725, 750, 800, 825, 850, 900, 925, 950, 1000, 1050, or 1100). In some cases, a lignin-modulating polypeptide can fit an HMM generated using the amino acid sequences set forth in FIG. 21 with an HMM bit score that is greater than about 420 (e.g., greater than about 450, 500, 550, 600, 625, 650, 675, or 700). In some cases, a lignin-modulating polypeptide can fit an HMM generated using the amino acid sequences set forth in FIG. 22 with an HMM bit score that is greater than about 375 (e.g., greater than about 380, 385, 390, or 400).

Nucleic Acids

A nucleic acid can comprise a coding sequence that encodes any of the lignin-modulating polypeptides as set forth in SEQ ID NO:96, SEQ ID NOs:98-107, SEQ ID NOs: 109-111, SEQ ID NOs:113-114, SEQ ID NOs:116-124, SEQ ID NOs:126-127, SEQ ID NOs:129-130, SEQ ID NO:132, SEQ ID NO:134, SEQ ID NO:136, SEQ ID NO:138, SEQ ID NO:140, SEQ ID NOs:142-143, SEQ ID NOs:145-147, SEQ ID NOs:149-150, SEQ ID NOs:152-156, SEQ ID NO:158, SEQ ID NOs:160-163, SEQ ID NO:165, SEQ ID NOs:167-174, SEQ ID NOs:176-181, SEQ ID NO:183, SEQ ID NO:185, SEQ ID NOs:187-188, SEQ ID NO:190, SEQ ID NOs:192-194, SEQ ID NOs:196-197, SEQ ID NO:199, SEQ ID NOs:201-202, SEQ ID NO:204, SEQ ID NO:206, SEQ ID NO:208, SEQ ID NOs:210-214, SEQ ID NO:216, SEQ ID NOs:218-220, SEQ ID NO:222, SEQ ID NO:224, SEQ ID NOs:226-227, SEQ ID NO:229, SEQ ID NO:231, SEQ ID NOs:233-238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NOs:

256-268, SEQ ID NOs:270-279, SEQ ID NOs:281-282, SEQ ID NO:284, SEQ ID NOs:286-287, SEQ ID NO:289, SEQ ID NOs:291-298, SEQ ID NO:300, SEQ ID NO:302, SEQ ID NOs:304-309, SEQ ID NOs:311-319, SEQ ID NOs:321-330, SEQ ID NOs:332-340, SEQ ID NO:342, SEQ ED NO:344, SEQ ID NOs:355-356, SEQ ID NOs:358-369, SEQ ID NO:371, SEQ ID NOs:373-385, SEQ ID NOs:390-395, SEQ ID NO:397, SEQ ID NO:399, SEQ ID NOs:401-407, SEQ ID NOs:409-463, SEQ ID NOs:465-496, SEQ ID NOs:498-500, SEQ ID NOs:502-503, SEQ ID NO:505, SEQ ID NOs:507-511, SEQ ID NOs:513-540, SEQ ID NO:542, SEQ ID NOs:544-571, SEQ ID NOs:579-581, SEQ ID NOs:583-587, SEQ ID NOs:589-590, SEQ ID NO:592, SEQ ID NOs:595-599, SEQ ID NOs:601-617, SEQ ID NO:619, SEQ ID NOs:621-638, SEQ ID NOs:640-672, SEQ ID NO:674, SEQ ID NOs:676-678, SEQ ID NO:680, SEQ ID NOs:682-685, SEQ ID NO:687, SEQ ID NO:689, SEQ ID NOs:691-714, SEQ ID NOs:716-717, SEQ ID NOs:719-737, SEQ ID NO:739, SEQ ID NOs:741-766, SEQ ID NO:768, SEQ ID NOs:770-776, SEQ ID NO:778, SEQ ID NOs:780-786, SEQ ID NOs:788-792, SEQ ID NO:794-807, and SEQ ID NOs:809-820.

Examples of nucleic acids encoding lignin-modulating polypeptides are set forth in SEQ ID NO:95, SEQ ID NO:97, SEQ ID NO:108, SEQ ID NO:112, SEQ ID NO:115, SEQ ID NO:125, SEQ ID NO:128, SEQ ID NO:131, SEQ ID NO:133, SEQ ID NO:135, SEQ ID NO:137, SEQ ID NO:139, SEQ ID NO:141, SEQ ID NO:144, SEQ ID NO:148, SEQ ID NO:151, SEQ ID NO:157, SEQ ID NO:159, SEQ ID NO:164, SEQ ID NO:166, SEQ ID NO:175, SEQ ID NO:182, SEQ ID NO:184, SEQ ID NO:186, SEQ ID NO:189, SEQ ID NO:191, SEQ ID NO:195, SEQ ID NO:198, SEQ ID NO:200, SEQ ID NO:203, SEQ ID NO:205, SEQ ID NO:207, SEQ ID NO:209, SEQ ID NO:215, SEQ ID NO:217, SEQ ID NO:221, SEQ ID NO:223, SEQ ID NO:225, SEQ ID NO:228, SEQ ID NO:230, SEQ ID NO:232, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:269, SEQ ID NO:280, SEQ ID NO:283, SEQ ID NO:285, SEQ ID NO:288, SEQ ID NO:290, SEQ ID NO:299, SEQ ID NO:301, SEQ ID NO:303, SEQ ID NO:310, SEQ ID NO:320, SEQ ID NO:331, SEQ ID NO:341, SEQ ID NO:343, SEQ ID NO:357, SEQ ID NO:370, SEQ ID NO:372, SEQ ID NO:386, SEQ ID NO:389, SEQ ID NO:396, SEQ ID NO:398, SEQ ID NO:400, SEQ ID NO:408, SEQ ID NO:464, SEQ ID NO:497, SEQ ID NO:501, SEQ ID NO:504, SEQ ID NO:506, SEQ ID NO:512, SEQ ID NO:541, SEQ ID NO:543, SEQ ID NO:578, SEQ ID NO:582, SEQ ID NO:584, SEQ ID NO:588, SEQ ID NO:591, SEQ ID NO:593, SEQ ID NO:600, SEQ ID NO:618, SEQ ID NO:620, SEQ ID NO:639, SEQ ID NO:673, SEQ ID NO:675, SEQ ID NO:679, SEQ ID NO:681, SEQ ID NO:686, SEQ ID NO:688, SEQ ID NO:690, SEQ ID NO:715, SEQ ID NO:718, SEQ ID NO:738, SEQ ID NO:740, SEQ ID NO:767, SEQ ID NO:769, SEQ ID NO:777, SEQ ID NO:779, SEQ ID NO:787, SEQ ID NO:793, and SEQ ID NO:808.

A nucleic acid also can be a fragment that is at least 40% (e.g., at least 45, 50, 55, 60, 65, 70, 75, 80, 85, 90, 95, or 99%) of the length of the nucleic acid set forth in SEQ ID NO:95, SEQ ID NO:97, SEQ ID NO:108, SEQ ID NO:112, SEQ ID NO:115, SEQ ID NO:125, SEQ ID NO:128, SEQ ID NO:131, SEQ ID NO:133, SEQ ID NO:135, SEQ ID NO:137, SEQ ID NO:139, SEQ ID NO:141, SEQ ID NO:144, SEQ ID NO:148, SEQ ID NO:151, SEQ ID NO:157, SEQ ID NO:159, SEQ ID NO:164, SEQ ID NO:166, SEQ ID NO:175, SEQ ID NO:182, SEQ ID NO:184, SEQ ID NO:186, SEQ ID NO:189, SEQ ID NO:191, SEQ ID NO:195, SEQ ID NO:198, SEQ ID NO:200, SEQ ID NO:203, SEQ ID NO:205, SEQ ID NO:207, SEQ ID NO:209, SEQ ID NO:215, SEQ ID NO:217, SEQ ID NO:221, SEQ ID NO:223, SEQ ID NO:225, SEQ ID NO:228, SEQ ID NO:230, SEQ ID NO:232, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:269, SEQ ID NO:280, SEQ ID NO:283, SEQ ID NO:285, SEQ ID NO:288, SEQ ID NO:290, SEQ ID NO:299, SEQ ID NO:301, SEQ ID NO:303, SEQ ID NO:310, SEQ ID NO:320, SEQ ID NO:331, SEQ ID NO:341, SEQ ID NO:343, SEQ ID NO:357, SEQ ID NO:370, SEQ ID NO:372, SEQ ID NO:386, SEQ ID NO:389, SEQ ID NO:396, SEQ ID NO:398, SEQ ID NO:400, SEQ ID NO:408, SEQ ID NO:464, SEQ ID NO:497, SEQ ID NO:501, SEQ ID NO:504, SEQ ID NO:506, SEQ ID NO:512, SEQ ID NO:541, SEQ ID NO:543, SEQ ID NO:578, SEQ ID NO:582, SEQ ID NO:584, SEQ ID NO:588, SEQ ID NO:591, SEQ ID NO:593, SEQ ID NO:600, SEQ ID NO:618, SEQ ID NO:620, SEQ ID NO:639, SEQ ID NO:673, SEQ ID NO:675, SEQ ID NO:679, SEQ ID NO:681, SEQ ID NO:686, SEQ ID NO:688, SEQ ID NO:690, SEQ ID NO:715, SEQ ID NO:718, SEQ ID NO:738, SEQ ID NO:740, SEQ ID NO:767, SEQ ID NO:769, SEQ ID NO:777, SEQ ID NO:779, SEQ ID NO:787, SEQ ID NO:793, and SEQ ID NO:808.

SEQ ID NO:108 is predicted to encode a polypeptide having the amino acid sequence set forth in SEQ ID NO:109.
SEQ ID NO:112 is predicted to encode the polypeptide having the amino acid sequence set forth in SEQ ID NO:113.
SEQ ID NO:115 is predicted to encode the polypeptide having the amino acid sequence set forth in SEQ ID NO:116.
SEQ ID NO:128 is predicted to encode the polypeptide having the amino acid sequence set forth in SEQ ID NO:129.
SEQ ID NO:131 is predicted to encode the polypeptide having the amino acid sequence set forth in SEQ ID NO:132.
SEQ ID NO:137 is predicted to encode the polypeptide having the amino acid sequence set forth in SEQ ID NO:138.
SEQ ID NO:139 is predicted to encode the polypeptide having the amino acid sequence set forth in SEQ ID NO:140.
SEQ ID NO:141 is predicted to encode the polypeptide having the amino acid sequence set forth in SEQ ID NO:142.
SEQ ID NO:144 is predicted to encode the polypeptide having the amino acid sequence set forth in SEQ ID NO:145.
SEQ ID NO:151 is predicted to encode the polypeptide having the amino acid sequence set forth in SEQ ID NO:152.
SEQ ID NO:157 is predicted to encode the polypeptide having the amino acid sequence set forth in SEQ ID NO:158.
SEQ ID NO:164 is predicted to encode the polypeptide having the amino acid sequence set forth in SEQ ID NO:165.
SEQ ID NO:166 is predicted to encode the polypeptide having the amino acid sequence set forth in SEQ ID NO:167.
SEQ ID NO:184 is predicted to encode the polypeptide having the amino acid sequence set forth in SEQ ID NO:185.
SEQ ID NO:186 is predicted to encode the polypeptide having the amino acid sequence set forth in SEQ ID NO:187.
SEQ ID NO:198 is predicted to encode the polypeptide having the amino acid sequence set forth in SEQ ID NO:199.
SEQ ID NO:200 is predicted to encode the polypeptide having the amino acid sequence set forth in SEQ ID NO:201.
SEQ ID NO:205 is predicted to encode the polypeptide having the amino acid sequence set forth in SEQ ID NO:206.

SEQ ID NO:207 is predicted to encode the polypeptide having the amino acid sequence set forth in SEQ ID NO:208.
SEQ ID NO:209 is predicted to encode the polypeptide having the amino acid sequence set forth in SEQ ID NO:210.
SEQ ID NO:223 is predicted to encode the polypeptide having the amino acid sequence set forth in SEQ ID NO:224.
SEQ ID NO:228 is predicted to encode the polypeptide having the amino acid sequence set forth in SEQ ID NO:229.
SEQ ID NO:230 is predicted to encode the polypeptide having the amino acid sequence set forth in SEQ ID NO:231.
SEQ ID NO:232 is predicted to encode the polypeptide having the amino acid sequence set forth in SEQ ID NO:233.
SEQ ID NO:241 is predicted to encode the polypeptide having the amino acid sequence set forth in SEQ ID NO:242.
SEQ ID NO:243 is predicted to encode the polypeptide having the amino acid sequence set forth in SEQ ID NO:244.
SEQ ID NO:245 is predicted to encode the polypeptide having the amino acid sequence set forth in SEQ ID NO:246.
SEQ ID NO:247 is predicted to encode the polypeptide having the amino acid sequence set forth in SEQ ID NO:248.
SEQ ID NO:249 is predicted to encode the polypeptide having the amino acid sequence set forth in SEQ ID NO:250.
SEQ ID NO:251 is predicted to encode the polypeptide having the amino acid sequence set forth in SEQ ID NO:252.
SEQ ID NO:253 is predicted to encode the polypeptide having the amino acid sequence set forth in SEQ ID NO:254.
SEQ ID NO:255 is predicted to encode the polypeptide having the amino acid sequence set forth in SEQ ID NO:256.
SEQ ID NO:269 is predicted to encode the polypeptide having the amino acid sequence set forth in SEQ FD NO:270.
SEQ ID NO:299 is predicted to encode the polypeptide having the amino acid sequence set forth in SEQ ID NO:300.
SEQ ID NO:301 is predicted to encode the polypeptide having the amino acid sequence set forth in SEQ ID NO:302.
SEQ ID NO:303 is predicted to encode the polypeptide having the amino acid sequence set forth in SEQ ID NO:304.
SEQ ID NO:310 is predicted to encode the polypeptide having the amino acid sequence set forth in SEQ ID NO:311.
SEQ ID NO:320 is predicted to encode the polypeptide having the amino acid sequence set forth in SEQ ID NO:321.
SEQ ID NO:331 is predicted to encode the polypeptide having the amino acid sequence set forth in SEQ ID NO:332.
SEQ ID NO:341 is predicted to encode the polypeptide having the amino acid sequence set forth in SEQ ID NO:342.
SEQ ID NO:343 is predicted to encode the polypeptide having the amino acid sequence set forth in SEQ ID NO:344.
SEQ ID NO:357 is predicted to encode the polypeptide having the amino acid sequence set forth in SEQ ID NO:358.
SEQ ID NO:370 is predicted to encode the polypeptide having the amino acid sequence set forth in SEQ ID NO:371.
SEQ ID NO:372 is predicted to encode the polypeptide having the amino acid sequence set forth in SEQ ID NO:373.
SEQ ID NO:386 is predicted to encode the polypeptide having the amino acid sequence set forth in SEQ ID NO:387.
SEQ ID NO:389 is predicted to encode the polypeptide having the amino acid sequence set forth in SEQ ID NO:390.
SEQ ID NO:396 is predicted to encode the polypeptide having the amino acid sequence set forth in SEQ ID NO:397.
SEQ ID NO:398 is predicted to encode the polypeptide having the amino acid sequence set forth in SEQ ID NO:399.
SEQ ID NO:400 is predicted to encode the polypeptide having the amino acid sequence set forth in SEQ ID NO:401.
SEQ ID NO:408 is predicted to encode the polypeptide having the amino acid sequence set forth in SEQ ID NO:409.
SEQ ID NO:464 is predicted to encode the polypeptide having the amino acid sequence set forth in SEQ ID NO:465.
SEQ ID NO:497 is predicted to encode the polypeptide having the amino acid sequence set forth in SEQ ID NO:498.
SEQ ID NO:501 is predicted to encode the polypeptide having the amino acid sequence set forth in SEQ ID NO:502.
SEQ ID NO:504 is predicted to encode the polypeptide having the amino acid sequence set forth in SEQ ID NO:505.
SEQ ID NO:506 is predicted to encode the polypeptide having the amino acid sequence set forth in SEQ ID NO:507.
SEQ ID NO:512 is predicted to encode the polypeptide having the amino acid sequence set forth in SEQ ID NO:513.
SEQ ID NO:541 is predicted to encode the polypeptide having the amino acid sequence set forth in SEQ ID NO:542.
SEQ ID NO:543 is predicted to encode the polypeptide having the amino acid sequence set forth in SEQ ID NO:544.
SEQ ID NO:578 is predicted to encode the polypeptide having the amino acid sequence set forth in SEQ ID NO:579.
SEQ ID NO:582 is predicted to encode the polypeptide having the amino acid sequence set forth in SEQ ID NO:583.
SEQ ID NO:584 is predicted to encode the polypeptide having the amino acid sequence set forth in SEQ ID NO:585.
SEQ ID NO:591 is predicted to encode the polypeptide having the amino acid sequence set forth in SEQ ID NO:592.
SEQ ID NO:593 is predicted to encode the polypeptide having the amino acid sequence set forth in SEQ ID NO:594.
SEQ ID NO:600 is predicted to encode the polypeptide having the amino acid sequence set forth in SEQ ID NO:601.
SEQ ID NO:618 is predicted to encode the polypeptide having the amino acid sequence set forth in SEQ ID NO:619.
SEQ ID NO:620 is predicted to encode the polypeptide having the amino acid sequence set forth in SEQ ID NO:621.
SEQ ID NO:639 is predicted to encode the polypeptide having the amino acid sequence set forth in SEQ ID NO:640.
SEQ ID NO:673 is predicted to encode the polypeptide having the amino acid sequence set forth in SEQ ID NO:674.
SEQ ID NO:675 is predicted to encode the polypeptide having the amino acid sequence set forth in SEQ ID NO:676.
SEQ ID NO:679 is predicted to encode the polypeptide having the amino acid sequence set forth in SEQ ID NO:680.
SEQ ID NO:681 is predicted to encode the polypeptide having the amino acid sequence set forth in SEQ ID NO:682.
SEQ ID NO:686 is predicted to encode the polypeptide having the amino acid sequence set forth in SEQ ID NO:687.
SEQ ID NO:688 is predicted to encode the polypeptide having the amino acid sequence set forth in SEQ ID NO:689.
SEQ ID NO:690 is predicted to encode the polypeptide having the amino acid sequence set forth in SEQ ID NO:691.
SEQ ID NO:715 is predicted to encode the polypeptide having the amino acid sequence set forth in SEQ ID NO:716.
SEQ ID NO:718 is predicted to encode the polypeptide having the amino acid sequence set forth in SEQ ID NO:719.
SEQ ID NO:738 is predicted to encode the polypeptide having the amino acid sequence set forth in SEQ ID NO:739.
SEQ ID NO:740 is predicted to encode the polypeptide having the amino acid sequence set forth in SEQ ID NO:741.
SEQ ID NO:767 is predicted to encode the polypeptide having the amino acid sequence set forth in SEQ ID NO:768.
SEQ ID NO:769 is predicted to encode the polypeptide having the amino acid sequence set forth in SEQ ID NO:770.
SEQ ID NO:777 is predicted to encode the polypeptide having the amino acid sequence set forth in SEQ ID NO:778.
SEQ ID NO:779 is predicted to encode the polypeptide having the amino acid sequence set forth in SEQ ID NO:780.
SEQ ID NO:787 is predicted to encode the polypeptide having the amino acid sequence set forth in SEQ ID NO:788.
SEQ ID NO:793 is predicted to encode the polypeptide having the amino acid sequence set forth in SEQ ID NO:795.
SEQ ID NO:808 is predicted to encode the polypeptide having the amino acid sequence set forth in SEQ ID NO:809.

In some cases, a recombinant nucleic acid construct can include a nucleic acid comprising less than the full-length coding sequence of a lignin-modulating polypeptide. In some cases, a recombinant nucleic acid construct can include a nucleic acid comprising a coding sequence, a gene, or a fragment of a coding sequence or gene in an antisense orientation so that the antisense strand of RNA is transcribed.

It will be appreciated that a number of nucleic acids can encode a polypeptide having a particular amino acid sequence. The degeneracy of the genetic code is well known to the art; i.e., for many amino acids, there is more than one nucleotide triplet that serves as the codon for the amino acid. For example, codons in the coding sequence for a given lignin-modulating polypeptide can be modified such that optimal expression in a particular plant species is obtained, using appropriate codon bias tables for that species.

A nucleic acid also can comprise a nucleotide sequence corresponding to any of the regulatory regions as set forth in SEQ ID NOs:1-94 or SEQ ID NOs:345-354. In some cases, a nucleic acid can comprise a nucleotide sequence corresponding to any of the regulatory regions set forth in SEQ ID NOs:1-94 or SEQ ID NOs:345-354, and a coding sequence that encodes any of the lignin-modulating polypeptides set forth in SEQ ID NO:96, SEQ ID NOs:98-107, SEQ ID NOs:109-111, SEQ ID NOs:113-114, SEQ ID NOs:116-124, SEQ ID NOs:126-127, SEQ ID NOs:129-130, SEQ ID NO:132, SEQ ID NO:134, SEQ ID NO:136, SEQ ID NO:138, SEQ ID NO:140, SEQ ID NOs:142-143, SEQ ID NOs:145-147, SEQ ID NOs:149-150, SEQ ID NOs:152-156, SEQ ID NO:158, SEQ ID NOs:160-163, SEQ ID NO:165, SEQ ID NOs:167-174, SEQ ID NOs:176-181, SEQ ID NO:183, SEQ ID NO:185, SEQ ID NOs:187-188, SEQ ID NO:190, SEQ ID NOs:192-194, SEQ ID NOs:196-197, SEQ ID NO:199, SEQ ID NOs:201-202, SEQ ID NO:204, SEQ ID NO:206, SEQ ID NO:208, SEQ ID NOs:210-214, SEQ ID NO:216, SEQ ID NOs:218-220, SEQ ID NO:222, SEQ ID NO:224, SEQ ID NOs:226-227, SEQ ID NO:229, SEQ ID NO:231, SEQ ID NOs:233-238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NOs:256-268, SEQ ID NOs:270-279, SEQ ID NOs:281-282, SEQ ID NO:284, SEQ ID NOs:286-287, SEQ ID NO:289, SEQ ID NOs:291-298, SEQ ID NO:300, SEQ ID NO:302, SEQ ID NOs:304-309, SEQ ID NOs:311-319, SEQ ID NOs:321-330, SEQ ID NOs:332-340, SEQ ID NO:342, SEQ ID NO:344, SEQ ID NOs:355-356, SEQ ID NOs:358-369, SEQ ID NO:371, SEQ ID NOs:373-385, SEQ ID NOs:390-395, SEQ ID NO:397, SEQ ID NO:399, SEQ ID NOs:401-407, SEQ ID NOs:409-463, SEQ ID NOs:465-496, SEQ ID NOs:498-500, SEQ ID NOs:502-503, SEQ ID NO:505, SEQ ID NOs:507-511, SEQ ID NOs:513-540, SEQ ID NO:542, SEQ ID NOs:544-571, SEQ ID NOs:579-581, SEQ ID NOs:583-587, SEQ ID NOs:589-590, SEQ ID NO:592, SEQ ID NOs:595-599, SEQ ID NOs:601-617, SEQ ID NO:619, SEQ ID NOs:621-638, SEQ ID NOs:640-672, SEQ ID NO:674, SEQ ID NOs:676-678, SEQ ID NO:680, SEQ ID NOs:682-685, SEQ ID NO:687, SEQ ID NO:689, SEQ ID NOs:691-714, SEQ ID NOs:716-717, SEQ ID NOs:719-737, SEQ ID NO:739, SEQ ID NOs:741-766, SEQ ID NO:768, SEQ ID NOs:770-776, SEQ ID NO:778, SEQ ID NOs:780-786, SEQ ID NOs:788-792, SEQ ID NO:794-807, and SEQ ID NOs:809-820.

The terms "nucleic acid" and "polynucleotide" are used interchangeably herein, and refer both to RNA and DNA, including cDNA, genomic DNA, synthetic DNA, and DNA (or RNA) containing nucleic acid analogs. Polynucleotides can have any three-dimensional structure. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, plasmids, vectors, isolated DNA of any sequence, isolated RNA of any sequence, nucleic acid probes, and primers, as well as nucleic acid analogs.

An isolated nucleic acid can be, for example, a naturally-occurring DNA molecule, provided one of the nucleic acid sequences normally found immediately flanking that DNA molecule in a naturally-occurring genome is removed or absent. Thus, an isolated nucleic acid includes, without limitation, a DNA molecule that exists as a separate molecule, independent of other sequences (e.g., a chemically synthesized nucleic acid, or a cDNA or genomic DNA fragment produced by the polymerase chain reaction (PCR) or restriction endonuclease treatment). An isolated nucleic acid also refers to a DNA molecule that is incorporated into a vector, an autonomously replicating plasmid, a virus, or into the genomic DNA of a prokaryote or eukaryote. In addition, an isolated nucleic acid can include an engineered nucleic acid such as a DNA molecule that is part of a hybrid or fusion nucleic acid. A nucleic acid existing among hundreds to millions of other nucleic acids within, for example, cDNA libraries or genomic libraries, or gel slices containing a genomic DNA restriction digest, is not to be considered an isolated nucleic acid.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from DNA as well as RNA, including sequences from total genomic DNA or total cellular RNA. Various PCR methods are described, for example, in *PCR Primer: A Laboratory Manual*, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

As used herein, the term "percent sequence identity" refers to the degree of identity between any given query sequence and a subject sequence. A subject sequence typically has a length that is more than 80%, e.g., more than 82%, 85%, 87%, 89%, 90%, 93%, 95%, 97%, 99%, 100%, 105%, 110%, 115%, or 120%, of the length of the query sequence. A query nucleic acid or amino acid sequence is aligned to one or more subject nucleic acid or amino acid sequences using the computer program ClustalW (version 1.83, default parameters), which allows alignments of nucleic acid or protein sequences to be carried out across their entire length (global alignment). Chenna et al., *Nucleic Acids Res.*, 31(13):3497-500 (2003).

ClustalW calculates the best match between a query and one or more subject sequences, and aligns them so that identities, similarities and differences can be determined. Gaps of one or more residues can be inserted into a query sequence, a Subject sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The output is a sequence alignment that reflects the relationship between sequences. ClustalW can be run, for example, at the Baylor College of Medicine Search Launcher site (searchlauncher.bcm.tmc.edu/multi-align/multi-align.html) and at the European Bioinformatics Institute site on the World Wide Web (ebi.ac.uk/clustalw).

To determine a percent identity between a query sequence and a subject sequence, ClustalW divides the number of identities in the best alignment by the number of residues compared (gap positions are excluded), and multiplies the result by 100. The output is the percent identity of the subject sequence with respect to the query sequence. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

The term "exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

Similarly, a lignin-modulating polypeptide can be endogenous or exogenous to a particular plant or plant cell. Exogenous lignin-modulating polypeptides, therefore, can include proteins that are native to a plant or plant cell, but that are expressed in a plant cell via a recombinant nucleic acid construct, e.g., a *Panicum* plant transformed with a recombinant nucleic acid construct encoding a *Panicum* transcription factor.

Likewise, a regulatory region can be exogenous or endogenous to a plant or plant cell. An exogenous regulatory region is a regulatory region that is part of a recombinant nucleic acid construct, or is not in its natural environment. For example, a *Nicotiana* promoter present on a recombinant nucleic acid construct is an exogenous regulatory region when a *Nicotiana* plant cell is transformed with the construct.

A transgenic plant or plant cell in which the amount and/or rate of biosynthesis of one or more sequences of interest is modulated includes at least one recombinant nucleic acid construct, e.g., a nucleic acid construct comprising a nucleic acid encoding a lignin-modulating polypeptide as described herein. In certain cases, more than one recombinant nucleic acid construct can be included (e.g., two, three, four, five, six, or more recombinant nucleic acid constructs). For example, two recombinant nucleic acid constructs can be included, where one construct includes a nucleic acid encoding one lignin-modulating polypeptide, and another construct includes a nucleic acid encoding a second lignin-modulating polypeptide.

Vectors containing nucleic acids such as those described herein also are provided. A "vector" is a replicon, such as a plasmid, phage, or cosmid, into which another DNA segment may be inserted so as to bring about the replication of the inserted segment. Generally, a vector is capable of replication when associated with the proper control elements. Suitable vector backbones include, for example, those routinely used in the art such as plasmids, viruses, artificial chromosomes, BACs, YACs, or PACs. The term "vector" includes cloning and expression vectors, as well as viral vectors and integrating vectors. An "expression vector" is a vector that includes a regulatory region. Suitable expression vectors include, without limitation, plasmids and viral vectors derived from, for example, bacteriophage, baculoviruses, and retroviruses. Numerous vectors and expression systems are commercially available from such corporations as Novagen (Madison, Wis.), Clontech (Mountain View, Calif.), Stratagene (La Jolla, Calif.), and Invitrogen/Life Technologies (Carlsbad, Calif.).

The vectors provided herein also can include, for example, origins of replication, scaffold attachment regions (SARs), and/or markers. A marker gene can confer a selectable phenotype on a plant cell. For example, a marker can confer biocide resistance, such as resistance to an antibiotic (e.g., kanamycin, G418, bleomycin, or hygromycin), or an herbicide (e.g., chlorosulfuron or phosphinothricin). In addition, an expression vector can include a tag sequence designed to facilitate manipulation or detection (e.g., purification or localization) of the expressed polypeptide. Tag sequences, such as green fluorescent protein (GFP), glutathione S-transferase (GST), polyhistidine, c-myc, hemagglutinin, or Flag™ tag (Kodak, New Haven, Conn.) sequences typically are expressed as a fusion with the encoded polypeptide. Such tags can be inserted anywhere within the polypeptide, including at either the carboxyl or amino terminus. As described herein, plant cells can be transformed with a recombinant nucleic acid construct to express a polypeptide of interest.

Regulatory Regions

The term "regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof.

As used herein, the term "operably linked" refers to positioning of a regulatory region and a sequence to be transcribed in a nucleic acid so as to influence transcription or translation of such a sequence. For example, to bring a coding sequence under the control of a regulatory region, the translation initiation site of the translational reading frame of the polypeptide is typically positioned between one and about fifty nucleotides downstream of the promoter. A regulatory region can, however, be positioned as much as about 5,000 nucleotides upstream of the translation initiation site, or about 2,000 nucleotides upstream of the transcription start site. A regulatory region typically comprises at least a core (basal) promoter. A regulatory region also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al., *The Plant Cell,* 1:977-984 (1989). The choice of regulatory regions to be included depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning regulatory regions relative to the coding sequence.

Some suitable regulatory regions initiate transcription only, or predominantly, in certain cell types. For example, a promoter that is active predominantly in a reproductive tissue (e.g., fruit, ovule, or inflorescence) can be used. Thus, as used herein a cell type- or tissue-preferential promoter is one that drives expression preferentially in the target tissue, but may also lead to some expression in other cell types or tissues as well. Methods for identifying and characterizing regulatory regions in plant genomic DNA include, for example, those described in the following references: Jordano et al., *Plant Cell,* 1:855-866 (1989); Bustos et al., *Plant Cell,* 1:839-854 (1989); Green et al., *EMBO J.,* 7:4035-4044 (1988); Meier et al., *Plant Cell,* 3:309-316 (1991); and Zhang et al., *Plant Physiology,* 110: 1069-1079 (1996).

Examples of various classes of regulatory regions are described below. Some of the regulatory regions indicated below as well as additional regulatory regions are described in more detail in U.S. Patent Application Ser. Nos. 60/505,689; 60/518,075; 60/544,771; 60/558,869; 60/583,691; 60/619,181; 60/637,140; 60/757,544; 60/776,307; 10/957,569; Ser. Nos. 11/058,689; 11/172,703; 11/208,308; 11/274,890; 60/583,609; 60/612,891; Ser. Nos. 11/097,589; 11/233,726; 11/408,791; 11/414,142; 10/950,321; 11/360,017; PCT/US05/011105; PCT/US05/034308; and PCT/US05/23639. Nucleotide sequences of regulatory regions are set forth in SEQ ID NOs:1-94 and SEQ ID NOs:345-354. It will be appreciated that a regulatory region may meet criteria for one classification based on its activity in one plant species, and yet meet criteria for a different classification based on its activity in another plant species.

Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326 (SEQ ID NO:76), YP0144 (SEQ ID NO:54), YP0190 (SEQ ID NO:59), p13879 (SEQ ID NO:75), YP0050 (SEQ ID NO:35), p32449 (SEQ ID NO:77), 21876 (SEQ ID NO:1), YP0158 (SEQ ID NO:57), YP0214 (SEQ ID NO:61), YP0380 (SEQ ID NO:70), PT0848 (SEQ ID NO:26), and PT0633 (SEQ ID NO:7) promoters. Additional examples include the cauliflower mosaic virus (CaMV) 35S promoter, the mannopine synthase (MAS) promoter, the 1' or 2' promoters derived from T-DNA of *Agrobacterium tumefaciens,* the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128 (SEQ ID NO:52), YP0275 (SEQ ID NO:63), PT0625 (SEQ ID NO:6), PT0660 (SEQ ID NO:9), PT0683 (SEQ ID NO:14), and PT0758 (SEQ ID NO:22) promoters. Other root-preferential promoters include the PT0613 (SEQ ID NO:5), PT0672 (SEQ ID NO:11), PT0688 (SEQ ID NO:15), and PT0837 (SEQ ID NO:24) promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA,* 86:7890-7894 (1989)), root cell specific promoters reported by Conkling et al., *Plant Physiol.,* 93:1203-1211 (1990)), and the tobacco RD2 promoter.

Ovary Tissue Promoters

Promoters that are active in ovary tissues such as the ovule wall and mesocarp can also be useful, e.g., a polygalacturonidase promoter, the banana TRX promloter, the melon actin promoter, YP0396 (SEQ ID NO:74), and PT0623 (SEQ ID NO:94). Examples of promoters that are active primarily in ovules include YP0007 (SEQ ID NO:30), YP0111 (SEQ ID NO:46), YP0092 (SEQ ID NO:38), YP0103 (SEQ ID NO:43), YP0028 (SEQ ID NO:33), YP0121 (SEQ ID NO:51), YP0008 (SEQ ID NO:31), YP0039 (SEQ ID NO:34), YP0115 (SEQ ID NO:47), YP0119 (SEQ ID NO:49), YP0120 (SEQ ID NO:50), and YP0374 (SEQ ID NO:68).

Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.,* 35:773-778 (1994)), the Cab-1 promoter from wheat (Fejes et al., *Plant Mol. Biol.,* 15:921-932 (1990)), the CAB-1 promoter from spinach (Lubberstedt et al., *Plant Physiol.,* 104: 997-1006 (1994)), the cab1R promoter from rice (Luan et al., *Plant Cell,* 4:971-981 (1992)), the pyruvate orthophosphate dikinase (PPDK) promoter from corn (Matsuoka et al., *Proc. Natl. Acad. Sci. USA,* 90:9586-9590 (1993)), the tobacco Lhcb1*2 promoter (Cerdan et al., *Plant Mol. Biol.*, 33:245-255 (1997)), the *Arabidopsis thaliana* SUC2 sucrose-$H^+$ symporter promoter (Truernit et al., *Planta*, 196:564-570 (1995)), and thylakoid membrane protein promoters from spinach (psaD, psaF, psaE, PC, FNR, atpC, atpD, cab, rbcS). Other photosynthetic tissue promoters include PT0535 (SEQ ID NO:3), PT0668 (SEQ ID NO:2), PT0886 (SEQ ID NO:29), YP0144 (SEQ ID NO:55), YP0380 (SEQ ID NO:70), and PT0585 (SEQ ID NO:4).

Lignin Biosynthesis Promoters

Lignin biosynthesis promoters are promoters that drive transcription of nucleic acids encoding enzymes involved in lignin biosynthesis. Such enzymes include, without limitation, 4-(hydroxy)cinnamoyl CoA ligase (EC 6.2.1.12), ferulate 5-hydroxylase, cinnamoyl CoA reductase (EC 1.2.1.44), cinnamate 4-hydroxylase (EC 1.14.13.11), and cinnamyl alcohol dehydrogenase (EC 1.1.1.195). Examples of lignin biosynthesis promoters from Populus are set forth in SEQ ID NOs:345-354. Other examples of lignin biosynthesis promoters include promoters of the switchgrass (*Panicum virgatum*), rice (*Oryza sativa*), corn (*Zea mays*), and wheat (*Triticum aestivum*) homologs of the *Populus* cinnamate 4-hydroxylase, caffeoyl-CoA O-methyltransferase, and caffeic acid O-methyltransferase genes. Also suitable are promoters of *Arabidopsis* genes encoding phenylalanin ammonia lyase (genomic locus At3g10340), trans-cinnamate 4-hydroxylase (genomic locus At2g30490), 4-coumarate:CoA ligase (genomic locus At1g51680), hydroxycinnamoyl-CoA:shikimate/quinate hydroxycinnamoyltransferase (genomic locus At5g48930), p-Coumarate 3-hydroxylase (genomic locus At2g40890), caffeoyl-CoA 3-O-methyltransferase (genomic locus At4g34050), cinnamoyl CoA reductase (genomic locus At1g15950), ferulate 5-hydroxylase (genomic locus At4g36220), caffeic acid O-methyltransferase (genomic locus At5g54160), and cinnamyl alcohol dehydrogenase (genomic locus At4g34230).

Cell Wall Related Promoters

Useful promoters also include cell wall related promoters, such as cellulose biosynthesis promoters. Cellulose biosynthesis promoters are promoters that drive transcription of nucleic acids encoding enzymes involved in cellulose biosynthesis. Examples of cellulose biosynthesis promoters include the promoter of the rice cellulose synthase gene (genomic locus Os08g25710), the promoter of the rice cellulose synthase gene (genomic locus Os08g06380), and the promoter of the rice cellulose synthase-like A2 gene (genomic locus Os10g26630).

Vascular Tissue Promoters

Examples of promoters that have high or preferential activity in vascular bundles include YP0087 (SEQ ID NO:86), YP0093 (SEQ ID NO:87), YP0108 (SEQ ID NO:88), YP0022 (SEQ ID NO:89), and YP0080 (SEQ ID NO:90). Other vascular tissue-preferential promoters include the glycine-rich cell wall protein GRP 1.8 promoter (Keller and Baumgartner, *Plant Cell*, 3(10):1051-1061 (1991)), the Commelina yellow mottle virus (CoYMV) promoter (Medberry et al., *Plant Cell*, 4(2):185-192 (1992)), and the rice tungro bacilliform virus (RTBV) promoter (Dai et al., *Proc. Natl. Acad. Sci. USA*, 101(2):687-692 (2004)). Promoters having preferential activity in the phloem region (e.g., primary phloem cells, companion cells, and sieve cells), the xylem region (e.g., tracheids and vessels), the bundle sheath layer and/or the endodermis are also considered vascular tissue promoters.

Stem Promoters

Promoters that have preferential activity in the pith, cortex, epidermis, and/or in the vascular bundles or vascular layers of the stem are considered stem promoters. Examples of these promoters are YP0356 (SEQ ID NO:67), YP0108 (SEQ ID NO:88), PT0684, PT0565 (SEQ ID NO:84), PT0710 (SEQ ID NO:18), and YP0080 (SEQ ID NO:90). In some cases, the stem promoters can also be induced by stress like drought (e.g., YP0356 and PT0710).

Inducible Promoters

Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380 (SEQ ID NO:70), PT0848 (SEQ ID NO:26), YP0381 (SEQ ID NO:71), YP0337 (SEQ ID NO:66), PT0633 (SEQ ID NO:7), YP0374 (SEQ ID NO:68), PT0710 (SEQ ID NO:18), YP0356 (SEQ ID NO:67), YP0385 (SEQ ID NO:73), YP0396 (SEQ ID NO:74), YP0388 (SEQ ID NO:92), YP0384 (SEQ ID NO:72), PT0688 (SEQ ID NO:15), YP0286 (SEQ ID NO:65), YP0377 (SEQ ID NO:69), PD1367 (SEQ ID NO:78), and PD0901 (SEQ ID NO:93). Examples of nitrogen-inducible promoters include PT0863 (SEQ ID NO:27), PT0829 (SEQ ID NO:23), PT0665 (SEQ ID NO:10), and PT0886 (SEQ ID NO:29). Examples of shade-inducible promoters include PR0924 (SEQ ID NO:91) and PT0678 (SEQ ID NO:13).

Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

Other Promoters

Other classes of promoters include, but are not limited to, shoot-preferential, callus-preferential, trichome cell-preferential, guard cell-preferential such as PT0678 (SEQ ID NO:13), tuber-preferential, parenchyma cell-preferential, and senescence-preferential promoters. Promoters designated YP0086 (SEQ ID NO:36), YP0188 (SEQ ID NO:58), YP0263 (SEQ ID NO:62), PT0758 (SEQ ID NO:22), PT0743 (SEQ ID NO:21), PT0829 (SEQ ID NO:23), YP0119 (SEQ ID NO:49), and YP0096 (SEQ ID NO:39), as described in the above-referenced patent applications, may also be useful.

Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, for example, more than one regulatory region can be operably linked to the sequence of a polynucleotide encoding a lignin-modulating polypeptide.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

Methods of Inhibiting Expression of a Sequence of Interest

The polynucleotides and recombinant vectors described herein can be used to express or inhibit expression of a gene, such as an endogenous gene involved in lignin biosynthesis, e.g., to alter a lignin biosynthetic pathway in a plant species of interest. The term "expression" refers to the process of converting genetic information of a polynucleotide into RNA through transcription, which is catalyzed by an enzyme, RNA polymerase, and into protein, through translation of mRNA on ribosomes. "Up-regulation" or "activation" refers to regulation that increases the production of expression products (mRNA, polypeptide, or both) relative to basal or native states, while "down-regulation" or "repression" refers to regulation that decreases production of expression products (mRNA, polypeptide, or both) relative to basal or native states.

"Modulated level of gene expression" as used herein refers to a comparison of the level of expression of a transcript of a gene or the amount of its corresponding polypeptide in the presence and absence of a lignin-modulating polypeptide described herein, and refers to a measurable or observable change in the level of expression of a transcript of a gene or the amount of its corresponding polypeptide relative to a control plant or plant cell under the same conditions (e.g., as measured through a suitable assay such as quantitative RT-PCR, a Northern blot, a Western blot, or through an observable change in phenotype, chemical profile, or metabolic profile). A modulated level of gene expression can include up-regulated or down-regulated expression of a transcript of a gene or polypeptide relative to a control plant or plant cell under the same conditions. Modulated expression levels can occur under different environmental or developmental conditions or in different locations than those exhibited by a plant or plant cell in its native state.

A number of nucleic acid based methods, including antisense RNA, ribozyme directed RNA cleavage, post-transcriptional gene silencing (PTGS), e.g., RNA interference (RNAi), and transcriptional gene silencing (TGS) can be used to inhibit gene expression in plants. Suitable polynucleotides include full-length nucleic acids encoding lignin-modulating polypeptides, or fragments of such full-length nucleic acids. In some embodiments, a complement of the full-length nucleic acid or a fragment thereof can be used. Typically, a fragment is at least 10 nucleotides, e.g., at least 12, 13, 14, 15, 16, 17, 18, 19, 20, 21, 22, 23, 24, 25, 26, 27, 30, 35, 40, 50, 80, 100, 200, 500 nucleotides or more. Generally, higher homology can be used to compensate for the use of a shorter sequence.

Antisense technology is one well-known method. In this method, a nucleic acid segment from a gene to be repressed is cloned and operably linked to a regulatory region and a transcription termination sequence so that the antisense strand of RNA is transcribed. The recombinant vector is then transformed into plants, as described below, and the antisense strand of RNA is produced. The nucleic acid segment need not be the entire sequence of the gene to be repressed, but typically will be substantially complementary to at least a portion of the sense strand of the gene to be repressed.

In another method, a nucleic acid can be transcribed into a ribozyme, or catalytic RNA, that affects expression of an mRNA. See, U.S. Pat. No. 6,423,885. Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contain a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman et al., *Proc. Natl. Acad. Sci. USA,* 92(13): 6175-6179 (1995); de Feyter and Gaudron, Methods in Molecular Biology, Vol. 74, Chapter 43, "Expressing Ribozymes in Plants", Edited by Turner, P. C., Humana Press Inc., Totowa, N.J. RNA endoribonucleases which have been described, such as the one that occurs naturally in *Tetrahymena thermophila*, can be useful. See, for example, U.S. Pat. Nos. 4,987,071 and 6,423,885.

PTGS, e.g., RNAi, can also be used to inhibit the expression of a gene. For example, a construct can be prepared that includes a sequence that is transcribed into an RNA that can anneal to itself, e.g., a double stranded RNA having a stem-loop structure. In some embodiments, one strand of the stem portion of a double stranded RNA comprises a sequence that is similar or identical to the sense coding sequence, or a fragment thereof, of the polypeptide of interest, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises a sequence that is similar or identical to the antisense strand, or a fragment thereof, of the coding sequence of the polypeptide of interest, and can have a length that is shorter, the same as, or longer than the corresponding length of the sense sequence. In some cases, one strand of the stem portion of a double stranded RNA comprises a sequence that is similar or identical to the 3' or 5' untranslated region, or a fragment thereof, of the mRNA encoding the polypeptide of interest, and the other strand of the stem portion of the double stranded RNA comprises a sequence that is similar or identical to the sequence that is complementary to the 3' or 5' untranslated region, respectively, or a fragment thereof, of the mRNA encoding the polypeptide of interest. In other embodiments, one strand of the stem portion of a double stranded RNA comprises a sequence that is similar or identical to the sequence of an intron or a fragment thereof in the pre-mRNA encoding the polypeptide of interest, and the other strand of the stem portion comprises a sequence that is similar or identical to the sequence that is complementary to the sequence of the intron or fragment thereof in the pre-mRNA.

The loop portion of a double stranded RNA can be from 3 nucleotides to 5,000 nucleotides, e.g., from 3 nucleotides to 25 nucleotides, from 15 nucleotides to 1,000 nucleotides, from 20 nucleotides to 500 nucleotides, or from 25 nucleotides to 200 nucleotides. The loop portion of the RNA can include an intron or a fragment thereof. A double stranded RNA can have zero, one, two, three, four, five, six, seven, eight, nine, ten, or more stem-loop structures.

A construct including a sequence that is operably linked to a regulatory region and a transcription termination sequence, and that is transcribed into an RNA that can form a double stranded RNA, is transformed into plants as described below. Methods for using RNAi to inhibit the expression of a gene are known to those of skill in the art. See, e.g., U.S. Pat. Nos. 5,034,323; 6,326,527; 6,452,067; 6,573,099; 6,753,139; and 6,777,588. See also WO 97/01952; WO 98/53083; WO 99/32619; WO 98/36083; and U.S. Patent Publications 20030175965, 20030175783, 20040214330, and 20030180945.

Constructs containing regulatory regions operably linked to nucleic acid molecules in sense orientation can also be used to inhibit the expression of a gene. The transcription product can be similar or identical to the sense coding sequence of a polypeptide of interest. The transcription product can also be unpolyadenylated, lack a 5' cap structure, or contain an unsplicable intron. Methods of inhibiting gene expression using a full-length cDNA as well as a partial cDNA sequence are known in the art. See, e.g., U.S. Pat. No. 5,231,020.

In some embodiments, a construct containing a nucleic acid having at least one strand that is a template for both sense and antisense sequences that are complementary to each other is used to inhibit the expression of a gene. The sense and antisense sequences can be part of a larger nucleic acid molecule or can be part of separate nucleic acid molecules having sequences that are not complementary. The sense or antisense sequence can be a sequence that is identical or complementary to the sequence of an mRNA, the 3' or 5' untranslated region of an mRNA, or an intron in a pre-mRNA encoding a polypeptide of interest, or a fragment of such sequences. In some embodiments, the sense or antisense sequence is identical or complementary to a sequence of the regulatory region that drives transcription of the gene encoding a polypeptide of interest. In each case, the sense sequence is the sequence that is complementary to the antisense sequence.

The sense and antisense sequences can be any length greater than about 12 nucleotides (e.g., 13, 14, 15, 16, 17, 18, 19, 20, 21, 22, 23, 24, 25, 26, 27, 28, 29, 30, or more nucleotides). For example, an antisense sequence can be 21 or 22 nucleotides in length. Typically, the sense and antisense sequences range in length from about 15 nucleotides to about 30 nucleotides, e.g., from about 18 nucleotides to about 28 nucleotides, or from about 21 nucleotides to about 25 nucleotides.

In some embodiments, an antisense sequence is a sequence complementary to an mRNA sequence encoding a lignin-modulating polypeptide set forth in SEQ ID NO:96, SEQ ID NOs:98-107, SEQ ID NOs:109-111, SEQ ID NOs:113-114, SEQ ID NOs:116-124, SEQ ID NOs:126-127, SEQ ID NOs:129-130, SEQ ID NO:132, SEQ ID NO:134, SEQ ID NO:136, SEQ ID NO:138, SEQ ID NO:140, SEQ ID NOs:142-143, SEQ ID NOs:145-147, SEQ ID NOs:149-150, SEQ ID NOs:152-156, SEQ ID NO:158, SEQ ID NOs:160-163, SEQ ID NO:165, SEQ ID NOs:167-174, SEQ ID NOs:176-181, SEQ ID NO:183, SEQ ID NO:185, SEQ ID NOs:187-188, SEQ ID NO:190, SEQ ID NOs:192-194, SEQ ID NOs:196-197, SEQ ID NO:199, SEQ ID NOs:201-202, SEQ ID NO:204, SEQ ID NO:206, SEQ ID NO:208, SEQ ID NOs:210-214, SEQ ID NO:216, SEQ ID NOs:218-220, SEQ ID NO:222, SEQ ID NO:224, SEQ ID NOs:226-227, SEQ ID NO:229, SEQ ID NO:231, SEQ ID NOs:233-238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NOs:256-268, SEQ ID NOs:270-279, SEQ ID NOs:281-282, SEQ ID NO:284, SEQ ID NOs:286-287, SEQ ID NO:289, SEQ ID NOs:291-298, SEQ ID NO:300, SEQ ID NO:302, SEQ ID NOs:304-309, SEQ ID NOs:311-319, SEQ ID NOs:321-330, SEQ ID NOs:332-340, SEQ ID NO:342, SEQ ID NO:344, SEQ ID NOs:355-356, SEQ ID NOs:358-369, SEQ ID NO:371, SEQ ID NOs:373-385, SEQ ID NOs:390-395, SEQ ID NO:397, SEQ ID NO:399, SEQ ID NOs:401-407, SEQ ID NOs:409-463, SEQ ID NOs:465-496, SEQ ID NOs:498-500, SEQ ID NOs:502-503, SEQ ID NO:505, SEQ ID NOs:507-511, SEQ ID NOs:513-540, SEQ ID NO:542, SEQ ID NOs:544-571, SEQ ID NOs:579-581, SEQ ID NOs:583-587, SEQ ID NOs:589-590, SEQ ID NO:592, SEQ ID NOs:595-599, SEQ ID NOs:601-617, SEQ ID NO:619, SEQ ID NOs:621-638, SEQ ID NOs:640-672, SEQ ID NO:674, SEQ ID NOs:676-678, SEQ ID NO:680, SEQ ID NOs:682-685, SEQ ID NO:687, SEQ ID NO:689, SEQ ID NOs:691-714, SEQ ID NOs:716-717, SEQ ID NOs:719-737, SEQ ID NO:739, SEQ ID NOs:741-766, SEQ ID NO:768, SEQ ID NOs:770-776, SEQ ID NO:778, SEQ ID NOs:780-786, SEQ ID NOs:788-792, SEQ ID NO:794-807, or SEQ ID NOs:809-820.

The sense sequence complementary to the antisense sequence can be a sequence present within the mRNA of a lignin-modulating polypeptide. Typically, sense and antisense sequences are designed to correspond to a 15-30 nucleotide sequence of a target mRNA such that the level of that target mRNA is reduced.

In some embodiments, a construct containing a nucleic acid having at least one strand that is a template for more than one sense sequence (e.g., 2, 3, 4, 5, 6, 7, 8, 9, 10 or more sense sequences) can be used to inhibit the expression of a gene. Likewise, a construct containing a nucleic acid having at least one strand that is a template for more than one antisense sequence (e.g., 2, 3, 4, 5, 6, 7, 8, 9, 10 or more antisense sequences) can be used to inhibit the expression of a gene. For example, a construct can contain a nucleic acid having at least one strand that is a template for two sense sequences and two antisense sequences. The multiple sense sequences can be identical or different, and the multiple antisense sequences can be identical or different. For example, a construct can have a nucleic acid having one strand that is a template for two identical sense sequences and two identical antisense sequences that are complementary to the two identical sense sequences. Alternatively, an isolated nucleic acid can have one strand that is a template for (1) two identical sense sequences 20 nucleotides in length, (2) one antisense sequence that is complementary to the two identical sense sequences 20 nucleotides in length, (3) a sense sequence 30 nucleotides in length, and (4) three identical antisense sequences that are complementary to the sense sequence 30 nucleotides in length. The constructs provided herein can be designed to have any arrangement of sense and antisense sequences. For example, two identical sense sequences can be followed by two identical antisense sequences or can be positioned between two identical antisense sequences.

A nucleic acid having at least one strand that is a template for one or more sense and/or antisense sequences can be operably linked to a regulatory region to drive transcription of an RNA molecule containing the sense and/or antisense sequence(s). In addition, such a nucleic acid can be operably linked to a transcription terminator sequence, such as the terminator of the nopaline synthase (nos) gene. In some cases, two regulatory regions can direct transcription of two transcripts: one from the top strand, and one from the bottom strand. See, for example, Yan et al., *Plant Physiol.*, 141:1508-1518 (2006). The two regulatory regions can be the same or different. The two transcripts can form double-stranded RNA molecules that induce degradation of the target RNA. In some cases, a nucleic acid can be positioned within a T-DNA or P-DNA such that the left and right T-DNA border sequences, or the left and right border-like sequences of the P-DNA, flank or are on either side of the nucleic acid. The nucleic acid sequence between the two regulatory regions can be from about 15 to about 300 nucleotides in length. In some embodiments, the nucleic acid sequence between the two regulatory regions is from about 15 to about 200 nucleotides in length, from about 15 to about 100 nucleotides in length, from about 15 to about 50 nucleotides in length, from about 18 to about 50 nucleotides in length, from about 18 to about 40 nucleotides in length, from about 18 to about 30 nucleotides in length, or from about 18 to about 25 nucleotides in length.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller, 1997, *Antisense Nucleic Acid Drug Dev.*, 7:187-195; Hyrup et al., *Bioorgan. Med. Chem.*, 4:5-23 (1996). In addition, the deoxyphosphate backbone can be replaced with, for example, a phosphorothioate or phosphorodithioate backbone, a phosphoroamidite, or an alkyl phosphotriester backbone.

Transgenic Plant Cells and Plants

Provided herein are transgenic plant cells and plants comprising at least one recombinant nucleic acid construct or exogenous nucleic acid. A recombinant nucleic acid construct or exogenous nucleic acid can include a regulatory region as described herein, a nucleic acid encoding a lignin-modulating polypeptide as described herein, or both. In certain cases, a transgenic plant cell or plant comprises at least two recombinant nucleic acid constructs or exogenous nucleic acids, e.g., one including a nucleic acid encoding one lignin-modulating polypeptide, and another including a nucleic acid encoding a second lignin-modulating polypeptide.

A plant or plant cell used in methods of the invention contains a recombinant nucleic acid construct as described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Typically, transgenic plant cells used in methods described herein constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species or for further selection of other desirable traits. Alternatively, transgenic plants can be propagated vegetatively for those species amenable to such techniques. Progeny includes descendants of a particular plant or plant line provided the progeny inherits the transgene. Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. Seeds produced by a transgenic plant can be grown and then selfed (or outcrossed and selfed) to obtain seeds homozygous for the nucleic acid construct.

Transgenic plant cells growing in suspension culture, or tissue or organ culture, can be useful for extraction of polypeptides or compounds of interest, e.g., lignin monomers, compounds in a lignin biosynthetic pathway, or flavonoids. For the purposes of this invention, solid and/or liquid tissue culture techniques can be used. When using solid medium, transgenic plant cells can be placed directly onto the medium or can be placed onto a filter film that is then placed in contact with the medium. When using liquid medium, transgenic plant cells can be placed onto a floatation device, e.g., a porous membrane that contacts the liquid medium. Solid medium typically is made from liquid medium by adding agar. For example, a solid medium can be Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous lignin-modulating polypeptide whose expression has not previously been confirmed in particular recipient cells.

Techniques for introducing nucleic acids into monocotyledonous and dicotyledonous plants are known in the art, and include, without limitation, *Agrobacterium*-mediated transformation, viral vector-mediated transformation, electroporation and particle gun transformation, e.g., U.S. Pat. Nos. 5,538,880, 5,204,253, 6,329,571 and 6,013,863. If a cell or tissue culture is used as the recipient tissue for transformation, plants can be regenerated from transformed cultures if desired, by techniques known to those skilled in the art. See, e.g., Niu et al., *Plant Cell Rep.* V19:304-310 (2000); Chang and Yang, *Bot. Bull. Acad. Sin.*, V37:35-40 (1996), and Han et al., Biotechnology in Agriculture and Forestry, V44:291 (ed. by Y. P. S. Bajaj), Springer-Vernag, (1999).

A population of transgenic plants can be screened and/or selected for those members of the population that have a desired trait or phenotype conferred by expression of the transgene. Selection and/or screening can be carried out over one or more generations, which can be useful to identify those plants that have a desired trait, such as an increased lignin content. Selection and/or screening can also be carried out in more than one geographic location. In some cases, transgenic plants can be grown and selected under conditions which induce a desired phenotype or are otherwise necessary to produce a desired phenotype in a transgenic plant. In addition, selection and/or screening can be carried out during a particular developmental stage in which the phenotype is exhibited by the plant.

Plant Species

The polynucleotides and vectors described herein can be used to transform a number of monocotyledonous and dicotyledonous plants and plant cell systems, including dicots such as alfalfa, ash, beech, birch, canola, cherry, clover, cotton, cottonseed, eucalyptus, flax, jatropha, mahogany, maple, mustard, oak, poplar, oilseed rape, rapeseed (high erucic acid and canola), red clover, teak, tomato, walnut, and willow, as well as monocots such as barley, bluegrass, canarygrass, corn, fescue, field corn, millet, miscanthus, oat, rice, rye, ryegrass, sorghum, sudangrass, sugarcane, sweet corn, switchgrass, turf grasses, timothy, and wheat. Gymnosperms such as fir, pine, and spruce can also be suitable.

Thus, the methods and compositions described herein can be used with dicotyledonous plants belonging, for example, to the orders *Asterales, Capparales, Euphorbiales, Fabales, Fagales, Juglandales, Lamiales, Linales, Malvales, Myrtales, Rosales, Salicales, Sapindales, Scrophulariales*, and *Solanales*. The methods and compositions described herein also can be utilized with monocotyledonous plants such as those belonging to the order *Cyperales*, and with plants belonging to *Gymnospermae*, e.g., *Cycadales, Ephedrales, Ginkgoales, Gnetales*, and *Pinales*.

The methods and compositions can be used over a broad range of plant species, including species from the dicot genera *Acer, Afzelia, Arabidopsis, Betula, Brassica, Eucalyptus, Fagus, Fraxinus, Glycine, Gossypium, Jatropha, Juglans, Linum, Lycopersicon, Medicago, Micropus, Populus, Prunus, Quercus, Salix, Solanum, Tectona*, and *Trifolium*; and the monocot genera *Agrostis, Avena, Festuca, Hordeum, Lemna, Lolium, Milium, Miscanthus, Oryza, Panicum, Pennisetum, Phalaris, Phleum, Poa, Saccharum, Secale, Sorghum, Triticum, Zea*, and *Zoysia*; and the gymnosperm genera *Abies, Picea*, and *Pinus*.

In some embodiments, a plant is a member of the species *Festuca arundinacea, Miscanthus* hybrid (*Miscanthus×giganteus*), *Miscanthus sinensis, Miscanthus sacchariflorus, Panicum virgatum, Pennisetum purpureum, Phalaris arundinacea, Populus balsamifera, Saccharum* spp., *Secale cereale, Sorghum almum, Sorghum halcapense*, or *Sorghum vulgare*.

In certain embodiments, the polynucleotides and vectors described herein can be used to transform a number of monocotyledonous and dicotyledenous plants and plant cell systems, wherein such plants are hybrids of different species or varieties of a specific (e.g., *Saccharum* sp.×*Miscanthus* sp.)

Transgenic Plant Phenotypes

Materials and methods described herein are useful for modulating the amount and/or chemical composition of lignin in plants. For example, a transgenic plant, tissue, or cell comprising a recombinant nucleic acid expressing a lignin-modulating polypeptide can have a modulated amount and/or rate of lignin biosynthesis. Plants, tissues, or cells containing a recombinant nucleic acid construct described herein typically have a difference in the amount, rate of synthesis, and/or chemical composition of lignin, relative to a corresponding control plant, tissue, or cell that is not transformed with the recombinant nucleic acid construct.

A number of different types of lignin, based on chemical and structural features, can be produced by different species of plants, by different tissues of the same plant, or by different parts of the same plant cell. Such lignins include, without limitation, lignins comprising primarily or only coniferyl alcohols such as guaiacyl lignin, lignins comprising primarily or only sinapyl alcohols such as syringyl lignin, lignins comprising primarily or only p-coumaryl alcohols such asp-hydroxyphenyl lignin, and lignins comprising primarily or only coniferyl and sinapyl alcohols such as guaiacyl-syringyl lignin. In addition, other compounds can be incorporated into lignins, including, without limitation, coniferyl/sinapyl p-coumarate, coniferyl/sinapyl p-hydroxybenzoate, coniferyl/sinapyl acetate, ferulate esters, 5-hydroxy-coniferyl alcohol, 3,4-dihydroxy-cinnamyl alcohol, feruloyl amides such as tyramine ferulate, coniferaldehyde/sinapaldehyde, vanillin/syringaldehyde, benzodioxanes, 5-hydroxyguaiacyl, and dihydroconiferyl/dihydro-p-coumaryl alcohol.

Using the methods described herein, the amount and/or rate of synthesis of any type of lignin can be modulated, e.g., increased or decreased, in a transgenic plant, tissue, or cell relative to a control plant, tissue, or cell. In some cases, the amounts of two or more types of lignin (e.g., two, three, four, five, six, seven, eight, nine, ten or even more types of lignin) can be independently modulated relative to a control plant, tissue, or cell.

In some embodiments, the amount of lignin is decreased in transgenic plants, tissues, or cells described herein (e.g., transgenic plants expressing a lignin-modulating polypeptide or an antisense or double-stranded RNA targeted to a lignin-modulating polypeptide as described herein). A decrease ratio can be expressed as the ratio of the lignin in such a transgenic plant, tissue, or cell on a weight basis (e.g., fresh weight basis) as compared to the lignin in a corresponding control plant, tissue, or cell (e.g., a corresponding plant, tissue, or cell that lacks the recombinant nucleic acid encoding the lignin-modulating polypeptide or the antisense or double-stranded RNA targeted to a lignin-modulating polypeptide). The decrease ratio can be from about 0.05 to about 0.90. In certain cases, the ratio can be from about 0.2 to about 0.6, or from about 0.4 to about 0.6, or from about 0.3 to about 0.5, or from about 0.2 to about 0.4.

In some cases, a decrease in the amount of lignin in a transgenic plant expressing a lignin-modulating polypeptide as described herein can be calculated as a percent decrease in the weight of lignin extracted per weight of tissue of the transgenic plant relative to the weight of lignin extracted per weight of tissue of a corresponding control plant. For example, the amount of lignin in a tissue of a transgenic plant provided herein can be decreased by about 1% to about 10%, or about 5% to about 15%, or about 20% to about 50%, or about 25% to about 40%, or about 30% to about 60%, or about 50% to about 75%, or about 75% to about 90% relative to the amount of lignin in a tissue of a corresponding control plant.

The decrease in amount of lignin can be restricted in some embodiments to particular tissues and/or organs, relative to other tissues and/or organs. For example, a transgenic plant can have a decreased amount of lignin in stem tissue relative to leaf tissue. The decreased amount of lignin can be in the cell wall of plant cells such as tracheids, xylem fibres, and sclereids.

An increase in the amount of lignin in a transgenic plant, tissue, or cell expressing a regulatory protein as described herein can be from about 1.02-fold to about 10-fold, about 1.03-fold to about 1.7-fold, or about 1.04-fold to about 1.6-fold, or about 1.05-fold to about 1.7-fold, or about 1.06-fold to about 2.3-fold, or about 1.07-fold to about 2.5-fold, or about 1.08-fold to about 2-fold, or about 1.09-fold to about 2.4-fold, or about 1.1-fold to about 2-fold, or about 1.2-fold to about 3-fold, or about 1.3-fold to about 2.5-fold, or about 1.4-fold to about 3-fold, or about 1.5-fold to about 5-fold, or about 2-fold to about 6-fold, or about 2-fold to about 5-fold, or about 1.5-fold to 7-fold, or about 3-fold to about 4-fold, or about 3-fold to about 7.5-fold, or about 4-fold to about 8-fold, or about 5-fold to about 10-fold higher than the amount in corresponding control plants, tissues, or cells.

In some cases, an increase in the amount of lignin in a transgenic plant described herein can be calculated as a percent increase in the weight of lignin extracted per weight of tissue of the transgenic plant relative to the weight of lignin extracted per weight of tissue of a corresponding control plant. For example, the amount of lignin in a tissue of a transgenic plant provided herein can be increased by about 1% to about 10%, or about 5% to about 15%, or about 20% to about 50%, or about 25% to about 40%, or about 30% to about 60%, or about 50% to about 75%, or about 75% to about 100%, or about 90% to about 150%, or about 50% to about 200%, or about 100% to about 300%, or about 150% to about 500%, or about 200 to about 600%, or about 300% to about 800% relative to the amount of lignin in a tissue of a corresponding control plant.

In some embodiments, the lignin that is increased in a tissue of a transgenic plant described herein is either not produced or is not detectable in a corresponding tissue of a control plant. Thus, in such embodiments, the increase in lignin is infinitely high. For example, in certain cases, a lignin-modulating polypeptide described herein may activate a biosynthetic pathway in a plant tissue that is not normally activated or operational in a control plant tissue and one or more new types of lignin that were not previously produced in that plant tissue can be produced.

The increase in amount of lignin can be restricted in some embodiments to particular tissues and/or organs, relative to other tissues and/or organs. For example, a transgenic plant can have an increased amount of lignin in stem tissue relative to leaf tissue. The increased amount of lignin can be in the cell wall of plant cells such as tracheids, xylem fibres, and sclereids.

In some embodiments, the amount of lignin in transgenic switchgrass (*Panicum virgatum*) expressing a regulatory protein or an antisense or double-stranded RNA targeted to a regulatory protein as described herein can be decreased by about 40% to about 75%, or about 45% to about 70%, or about 48% to about 68%, or about 50% to about 66%, or about 53% to about 66%, or about 55% to about 65%, or about 57% to about 71%, or about 50% to about 70%, or about 55% to about 60%, or about 60% to about 65% by weight relative to the amount of lignin in corresponding control switchgrass (e.g., corresponding wild-type switchgrass or switchgrass that lacks the nucleic acid encoding the regulatory protein or the antisense or double-stranded RNA targeted to a regulatory protein). In some cases, the decrease ratio of lignin in transgenic switchgrass described herein as compared to the lignin in corresponding control switchgrass can be from about 0.4 to about 0.8, or about 0.4 to about 0.7, or about 0.45 to about 0.7, or about 0.5 to about 0.66, or about 0.5 to about 0.7, or about 0.5 to about 0.68, or about 0.55 to about 0.7, or about 0.6 to about 0.7, or about 0.53 to about 0.66.

In some embodiments, the amount of lignin in transgenic switchgrass expressing a regulatory protein or an antisense or double-stranded RNA targeted to a regulatory protein as described herein can be increased by about 100% to about 300%, or about 100% to about 275%, or about 125% to about 300%, or about 125% to about 275%, or about 150% to about 275%, or about 150% to about 250%, or about 175% to about 250%, or about 175% to about 225%, or about 100% to about 250%, or about 150% to 300% by weight as compared to the amount of lignin in corresponding control switchgrass. In some cases, an increase in lignin in transgenic switchgrass described herein can be from about 1.2-fold to about 3-fold, or about 1.3-fold to about 2-fold, or about 1.3-fold to about 2.5-fold, or about 1.5-fold to about 2.1-fold, or about 1.25-fold to about 2.75-fold, or about 1.2-fold to about 2.15-fold, or about 1.4-fold to about 2.8-fold, or about 1.5-fold to about 2.5-fold, or about 1.75-fold to about 2.75-fold, or about 1.2-fold to about 1.9-fold relative to corresponding control switchgrass.

The amount of lignin in a plant can be determined by known techniques, e.g., the acid detergent, Klason, acetyl bromide, and permanganate lignin methods. See, for example, Hatfield and Fukushima, *Crop Sci.*, 45:832-839 (2005); and *Methods in Lignin Chemistry*, Dence and Lin, eds., Springer-Verlag, Berlin, p. 33-61 (1992). Pyrolysis-gas chromatography-mass spectrometry, liquid chromatography-mass spectrometry (LC-MS), or a degradative method, e.g., the DFRC method or thioacidolysis, combined with mass spectrometry also can be used. If desired, the composition and structure of lignin can be characterized by GC-MS, LC-MS, nuclear magnetic resonance spectroscopy, Fourier-transform infrared spectroscopy, and/or other known techniques. In addition, histochemical analysis can be performed to determine the amount and distribution of lignin in a plant. For example, tissue sections can be stained with toluidine blue O (TBO), the Wiesner reagent, or the Maiule reagent. TBO is a metachromatic stain that imparts a turquoise color to lignified cell walls and stains non-lignified cell walls purple. Phloroglucinol stains lignified cells red upon reaction with hydroxycinnamaldehyde groups present in the polymer. The Mäule reagent is a histochemical stain that allows syringyl lignin to be distinguished chromogenically from guaiacyl lignin in situ. A pink or red color can indicate the presence of syringyl units, whereas a light to dark brown color can indicate the presence of guaiacyl units.

A transgenic plant, tissue, or cell expressing a lignin-modulating polypeptide described herein can have a modulated, e.g., increased or decreased, level of one or more compounds in a lignin biosynthesis pathway as compared to a control plant, tissue, or cell not transgenic for the particular lignin-modulating polypeptide. In certain cases, the amount of more than one compound (e.g., two, three, four, five, six, seven, eight, nine, ten or even more compounds) included in a lignin biosynthetic pathway can be modulated relative to a control plant, tissue, or cell that is not transgenic for a lignin-modulating polypeptide described herein. Such a compound can be, for example, a precursor compound, an intermediate compound, or an end product in a lignin biosynthesis pathway.

Compounds in a lignin biosynthesis pathway include, without limitation, phenylalanine, cinnamic acid, p-coumaric acid, p-coumaraldehyde, p-coumaryl alcohol, caffeic acid, ferulic acid, 5-hydroxy-ferulic acid, 5-hydroxy-feruloyl CoA, sinapic acid, sinapoyl CoA, p-coumaroyl CoA, p-coumaroyl shikimic acid, p-coumaroyl quinic acid, caffeoyl shikimic acid, caffeoyl quinic acid, caffeoyl CoA, feruloyl CoA, coniferaldehyde, 5-hydroxy-coniferaldehyde, sinapaldehyde, coniferyl alcohol, 5-hydroxy-coniferyl alcohol, sinapyl alcohol, caffeyl aldehyde, and caffeyl alcohol.

An increase in the amount of one or more compounds in a lignin biosynthesis pathway in transgenic cells or tissues expressing a lignin-modulating polypeptide described herein can be from about 1.2-fold to about 150-fold, about 1.3-fold to about 20-fold, or about 1.2-fold to about 3-fold, or about 1.3-fold to about 2-fold, or about 1.4-fold to about 3-fold, or about 2-fold to about 4-fold, or about 2-fold to about 5-fold, or about 1.5-fold to 7-fold, or about 3-fold to about 4-fold, or about 3-fold to about 7-fold, or about 4-fold to about 8-fold, or about 5-fold to about 10-fold, or about 10-fold to about 15-fold, or about 12-fold to about 18-fold, or about 14-fold to about 22-fold, or about 18-fold to about 30-fold, or about 10-fold to about 100-fold, or about 30-fold to about 100-fold, or about 75-fold to about 130-fold, or about 5-fold to about 50-fold, or about 40-fold to about 150-fold higher than the amount in corresponding control cells or tissues that lack the recombinant nucleic acid encoding the lignin-modulating polypeptide.

In some embodiments, the compound in a lignin biosynthesis pathway that is increased in transgenic cells expressing a lignin-modulating polypeptide described herein is either not produced or is not detectable in a corresponding control cell that lacks the recombinant nucleic acid encoding the lignin-modulating polypeptide. Thus, in such embodiments, the increase in such a compound is infinitely high as compared to corresponding control cells or tissues that lack the recombinant nucleic acid encoding the lignin-modulating polypeptide. For example, in certain cases, a lignin-modulating polypeptide described herein may activate a biosynthetic pathway in a plant that is not normally activated or operational in a control plant, and one or more compounds in a lignin biosynthetic pathway that were not previously produced in that plant species can be produced.

The increase in amount of one or more compounds in a lignin biosynthesis pathway can be restricted in some embodiments to particular tissues and/or organs, relative to other tissues and/or organs. For example, a transgenic plant can have an increased amount of a lignin biosynthesis compound in stem tissue relative to leaf or root tissue.

In some embodiments, the amount of one or more than one compound in a lignin biosynthesis pathway is decreased in transgenic cells expressing a lignin-modulating polypeptide as described herein. A decrease ratio can be expressed as the ratio of the compound in such a transgenic cell on a weight basis (e.g., fresh weight basis) as compared to the compound in a corresponding control cell that lacks the recombinant nucleic acid encoding the lignin-modulating polypeptide. The decrease ratio can be from about 0.05 to about 0.90. In certain cases, the ratio can be from about 0.2 to about 0.6, or from about 0.4 to about 0.6, or from about 0.3 to about 0.5, or from about 0.2 to about 0.4.

In certain embodiments, the compound in a lignin biosynthesis pathway that is decreased in transgenic cells expressing a lignin-modulating polypeptide as described herein is decreased to an undetectable level as compared to the level in corresponding control cells that lack the recombinant nucleic acid encoding the lignin-modulating polypeptide. Thus, in such embodiments, the decrease ratio for such a compound is zero.

The decrease in amount of one or more compounds in a lignin biosynthesis pathway can be restricted in some embodiments to particular tissues and/or organs, relative to other tissues and/or organs. For example, a transgenic plant can have a decreased amount of a compound in stem tissue relative to leaf tissue.

In some embodiments, the amounts of two or more compounds in a lignin biosynthesis pathway are increased and/or decreased, e.g., the amounts of two, three, four, five, six, seven, eight, nine, ten, or more, lignin compounds are independently increased and/or decreased. The amount of a lignin compound can be determined by known techniques, e.g., by extraction of compounds in a lignin biosynthesis pathway from a plant tissue followed by gas chromatography-mass spectrometry (GC-MS) or liquid chromatography-mass spectrometry (LC-MS). If desired, the structure of the lignin compound can be confirmed by GC-MS, LC-MS, nuclear magnetic resonance and/or other known techniques.

In addition to having a modulated amount of lignin and/or a modulated level of one or more than one compound in a lignin biosynthesis pathway, a transgenic plant or cell produced using the materials and methods described herein can produce one or more lignins having an altered structure and/or composition relative to the lignin(s) produced by a corresponding control plant or cell that is not transformed with the recombinant nucleic acid construct. For example, the lignin composition can be altered from essentially 100% guaiacyl units to essentially 100% syringyl units. In some cases, the ratio of syringyl to guaiacyl units incorporated into lignin in a transgenic plant can be modulated relative to the corresponding ratio in a control plant. For example, the ratio of syringyl to guaiacyl units can be increased, e.g., by 1.2-fold, 1.3-fold, 1.4-fold, 1.5-fold, 1.6-fold, 1.7-fold, 1.8-fold, 1.9-fold, 2.0-fold, 2.1-fold, 2.2-fold, 2.3-fold, 2.4-fold, 2.5-fold, 2.6-fold, 2.7-fold, 2.8-fold, 2.9-fold, 3.0-fold, or more than 3.0-fold, in a transgenic plant provided herein as compared to the corresponding ratio in a control plant. In some cases, the ratio of syringyl to guaiacyl units incorporated into lignin in a transgenic plant described herein can be decreased, e.g., by 5%, 10%, 15%, 20%, 25%, 30%, 35%, 40%, 45%, 50%, 60%, 70%, 80%, 90%, 100%, or more than 100%, as compared to the corresponding ratio in a control plant. In some cases, the composition of lignin can be altered in a transgenic plant by having compounds incorporated into lignin that are not normally incorporated into lignin in a wild-type plant. Such compounds can include, without limitation, dihydroconiferyl alcohol, coniferaldehyde, hydroxycinnamaldehydes, and hydroxybenzaldehydes. The composition of lignin in a plant can be determined using well known methods, such as those described herein.

Articles of Manufacture

The materials and methods described herein are useful for modifying biomass characteristics, such as characteristics of biomass renewable energy source plants. A biomass renewable energy source plant is a plant having or producing material (either raw or processed) that comprises stored solar energy that can be converted to fuel. In general terms, such plants comprise dedicated energy crops as well as agricultural and woody plants. Examples of biomass renewable energy source plants include:

switchgrass, elephant grass, giant chinese silver grass, energycane, giant reed (also known as wild cane), miscanthus, tall fescue, bermuda grass, sorghum, napier grass (also known as uganda grass), triticale, rye, winter wheat, shrub poplar, shrub willow, big bluestem, reed canary grass, and corn.

Transgenic plants provided herein have particular uses in agricultural industries. For example, transgenic plants, e.g., trees, described herein can be used to produce wood that is more lignified, and therefore more durable, than wood from corresponding wild-type plants. Such wood can serve as a superior wood fuel and/or raw material for applications such as woodworking. Transgenic plants such as trees having increased lignin content can also serve as sinks for carbon in the biosphere. Increased sequestration of carbon as lignin in transgenic plants may reduce atmospheric carbon dioxide and global warming. Transgenic plants having an increased lignin content can also be used to produce crops that are less susceptible to lodging. Increasing lignin in fruit, such as tomatoes, can increase the firmness of the fruit, thereby making it more amenable to shipping, storing, slicing, and dicing.

Also provided herein are transgenic plants, such as trees, having a reduced lignin content, which can be useful, e.g., to reduce the pulping cost and energy consumption in the pulping process used to make paper from wood. In addition, transgenic plants having a reduced lignin content can produce crops that are more digestible than crops produced from wild-type plants, which, in turn, can impact the livestock industry. Feeding dairy cattle corn silage produced from corn plants having a reduced and altered lignin content due to homozygosity at one or more bm loci can improve milk production (See, U.S. Pat. No. 6,114,609). Plants having a reduced lignin content also can be valuable for the production of biofuels. The crosslinking structure of lignin is known to complex with cellulose and hemicellulose, thus limiting the efficiency of the conversion process to produce ethanol from plant material. Reducing the lignin content in plants may increase the yield of ethanol from the plant material. See, for example, Mooney et al., *Bioresour Technol*, 64:113-119 (1998); Bernardez et al., *Biotechnol Bioeng.*, 42:899-907 (1993); Chernoglazov et al., *Enzyme Microbiol Technol*, 10:503-507 (1988); and Vinzant et al., *Appl Biochem Biotechnol*, 62:99-104 (1997).

Lignin itself, which can be harvested from transgenic plants provided herein, can be converted into valuable fuel additives. Lignin can be removed from wood pulp of transgenic trees having an increased lignin content, and lignin can be recovered from any bioethanol production process using agricultural materials such as straw, corn stalks and switchgrass engineered to have an increased lignin content. Lignin can be combusted to provide heat and/or power for the ethanol process; however, increasing the value of the lignin by converting it to higher value fuel additives can significantly enhance the competitiveness of bioethanol technology. Lignins removed from wood pulp as sulphates can be used as dust suppression agents for roads, as dispersants in high performance cement applications, water treatment formulations, and textile dyes, or as raw materials for several chemicals, such as vanillin, DMSA, ethanol, torula yeast, xylitol sugar, and humic acid.

Seeds of transgenic plants described herein can be conditioned and bagged in packaging material by means known in the art to form an article of manufacture. Packaging material such as paper and cloth are well known in the art. A package of seed can have a label, e.g., a tag or label secured to the packaging material, a label printed on the packaging material, or a label inserted within the package. The package label may indicate that the seed herein incorporates transgenes that provide increased amounts of lignin in one or more tissues of plants grown from such seeds.

The invention will be further described in the following examples, which do not limit the scope of the invention described in the claims.

EXAMPLES

Example 1

Histological Analysis of Lignin Content in Transgenic *Arabidopsis* Lines

Transgenic *Arabidopsis* lines were analyzed for lignin content using histological staining. Each transgenic line that was analyzed is listed in Table 1 along with identifiers for the corresponding nucleic acid used to transform *Arabidopsis* plants, the polypeptide encoded by the nucleic acid, and the promoter used to express the polypeptide.

TABLE 1

Transgenic *Arabidopsis* lines analyzed for lignin content

| Transgenic Line ID | Promoter | Nucleic Acid Clone_ID | Nucleic Acid Annot_ID | Nucleic Acid SEQ ID NO: | Polypeptide SEQ ID NO: |
|---|---|---|---|---|---|
| ME06087 | 35S | 11114 | | 225 | 226 |
| ME03210 | 35S | 108362 | | 221 | 222 |
| ME12890 | 35S | 21243 | | 283 | 284 |
| ME01050 | 32449 | 38915 | | 285 | 286 |
| ME01752 | 35S | 8049 | | 290 | 291 |
| ME04929 | 35S | 1006105 | | 215 | 216 |
| ME04199 | 35S | 1014844 | | 217 | 218 |
| ME04941 | 35S | 114130 | | 239 | 240 |
| ME01739 | 35S | 41046 | | 288 | 289 |
| ME18822 | 35S | | 860791 | 148 | 149 |
| ME18127 | 35S | | 869854 | 191 | 192 |
| ME13394 | 35S | | 867623 | 175 | 176 |
| ME17216 | 35S | | 858797 | 133 | 134 |
| ME20615 | 35S | | 870466 | 195 | 196 |
| ME05326 | 35S | | 535161 | 97 | 98 |
| ME05335 | 35S | | 535161 | 97 | 98 |
| ME11531 | 35S | | 837136 | 125 | 126 |
| ME17696 | 35S | | 868753 | 182 | 183 |
| ME07663 | 13879F | | 521911 | 95 | 96 |
| ME20794 | 35S | | 869790 | 189 | 190 |
| ME18779 | 35S | | 863641 | 159 | 160 |
| ME18169 | 35S | | 887718 | 203 | 204 |
| ME21595 | 35S | | 860676 | 135 | 136 |
| ME23567 | 35S | | | 343 | 344 |
| ME23565 | 35S | | | 341 | 342 |
| ME00259 | 32449 | 11988 | | 280 | 281 |

Seeds from the transgenic lines listed in Table 1 were sown in a 60:40 mixture of Sunshine Mix #5 and coarse vermiculite. The sown seeds were stratified for at least three days in a refrigerated cabinet prior to germination in the greenhouse.

To test the staining protocol and determine the optimum developmental stage for histology screening, wild-type plants were collected at different time points starting from the seedling stage just after bolting, about 16 to 18 days after germination, up to the mature stage, about 35 days after germination. Based on the results of this analysis, which are summarized in Table 2 below, *Arabidopsis* plants were allowed to grow for at least 24 to 26 days post-germination prior to performing the primary histological analysis.

Some of the transgenic lines were analyzed further for ectopic lignin accumulation. Transgenic *Arabidopsis* seedlings were collected two weeks post germination and incubated overnight in a 12-well dish containing 80% ethanol to remove the chlorophyll. In addition, mature rosette and cauline leaves were collected from transgenic plants five weeks after germination, placed in a 12-well dish, and processed in a manner similar to the manner in which the seedlings were processed.

Phloroglucinol Staining

For the primary histological analysis, the main inflorescence stem was cut at the basal end, about 0.5 cm from the junction of the rosette leaves, using a razor blade. Thin sections of the stems, about 200 microns thick, were manually generated using a razor blade against a Styrofoam support. Up to three individual plants were sampled from each transformation event. Up to five transformation events per transgenic line were used.

The tissue sections were immediately placed on a microscope slide and a drop of 1% phloroglucinol solution in 6 M HCl was placed on top of each section to adequately cover the sample for about two minutes. The phloroglucinol reagent present in the tissue sections was diluted by adding about five drops of water using a pipette. A cover slip was placed on the tissue sections in preparation for microscopy, and any excess liquid was removed with a tissue paper.

For seedlings and whole leaf tissues, ethanol was removed after overnight incubation and replaced with one mL of 1% phloroglucinol solution in 6 M HCl to cover the tissues in the well. The tissues were stained for about two minutes. The phloroglucinol solution was subsequently removed and replaced with one mL of water. The tissues were kept in the 12-well dish for scanning.

Microscopey, Image Acquisition, and Image Analysis

Digital images of tissue sections were taken in tif format at 50× magnification using a Carl Zeiss Axioshop 2 microscope set in a dark field view at 3200K exposure. The microscope was linked to Axiovision software version 3.1.2.1 set at 3200K white balance exposure. The tif format images were adjusted and converted into jpeg format using the Adobe Photoshop plug-in software (AGD Color Temperature Correction version 4) set at 6000K correction condition.

The adjusted jpeg format images were read by WinRhizo Pro software (Regent Instruments Inc.) using a calibration method to classify the pixels within the image view according to whether they belonged to stained lignified cells/tissues (designated as X), to non-lignified cells/tissues (designated as NL), or to the background (designated as B). The results of this "binning" process were exported into an Excel spreadsheet.

The lignified area within an image taken at 50× magnification was semi-quantified and represented as the ratio (R) of the lignified region relative to the whole tissue within an image. The R value was calculated as follows: $R=X/(X+NL)$. The R values from tissue sections of three plants per transformation event were averaged, and the standard deviation was calculated for each average R value. The average R value and standard deviation for each transformation event was compared to the average R value and standard deviation for the wild-type plants to determine whether the difference between the average R values was statistically significant.

The degree of increase or decrease in lignin content within the sampled stem sections of a transgenic line relative to the lignin content in sampled stem sections of wild-type plants was calculated using the following formula.

$$[(R_{transgenic})-(Average\ R_{Wild-type})]/(Average\ R_{Wild-type}) \times 100$$

A relative value, calculated using the formula above, that was positive indicated an increased lignin content in the transgenic line relative to wild-type plants (Table 3). A relative value that was negative indicated a decreased lignin content in the transgenic line relative to wild-type plants (Table 3).

The microscope images of stem tissue sections were also qualitatively inspected to determine if there was ectopic deposition of lignin in regions not normally lignified in wild-type stem tissues, or if there were developmental changes in tissue arrangement compared to the arrangement in wild-type plants.

Digital images of seedlings and whole leaf tissues were taken in jpeg format using an Epson 4870 Photo Scanner. Images of transgenic tissues were compared to images of wild-type tissues to qualitatively determine if there was ectopic or increased accumulation of lignin in organs from transgenic plants as compared to organs from wild-type plants.

Results of Histological Analysis

Results of the semi-quantitative analysis of the lignified areas of stem sections from wild-type *Arabidopsis* plants at different developmental stages are summarized in Table 2.

TABLE 2

Lignin content of wild-type *Arabidopsis* plants at different stages of development

| Development Stage (Days after Germination) | Stem Region | R value (Average) | Standard Deviation | Comments |
| --- | --- | --- | --- | --- |
| 18 | Top | N/A | | Tissues too soft for sectioning |
| | Middle | 0.03 | | Tissues still soft for sectioning |
| | Base | 0.06 | | Tissues still soft for sectioning |
| 24 | Top | N/A | | Tissues too soft for sectioning |
| | Middle | 0.25 | 0.04 | |
| | Base | 0.30 | 0.06 | |
| 25 | Top | N/A | | Tissues too soft for sectioning |
| | Middle | N/A | | |
| | Base | 0.29 | 0.03 | |
| 27 | Top | 0.17 | | Tissues still soft for sectioning |
| | Middle | 0.23 | 0.03 | |
| | Base | 0.32 | 0.10 | |
| 35 | Top | 0.23 | 0.08 | |
| | Middle | 0.21 | 0.005 | |
| | Base | 0.37 | 0.09 | Stem becoming brittle |

Based on the results presented in Table 2, the basal regions of transgenic and corresponding wild-type control plants between 24 to 26 days post germination were used for histological analysis. The results are summarized in Table 3.

TABLE 3

Summary of the histological analysis of lignin content in transgenic *Arabidopsis* lines

| Gemini ID or Genomic Locus | Construct Code | Transgenic line-event | Change in lignin content relative to wild-type controls | Observable Phenotype |
| --- | --- | --- | --- | --- |
| 5217C1[1] | 5217C1 | ME23567-01 | 76% Decrease | Shorter than wild-type |
| 5217G1[1] | 5217G1 | ME23565-04 | 33% Increase | Enlarged interfascicular cells towards the epidermis |
| At1g08200 | ANNOT ID 863641 | ME18779-01 | 14% Decrease | Shorter than wild-type |
| | | ME18779-05 | 14% Decrease | Shorter than wild-type |

TABLE 3-continued

Summary of the histological analysis of lignin content in transgenic *Arabidopsis* lines

| Gemini ID or Genomic Locus | Construct Code | Transgenic line-event | Change in lignin content relative to wild-type controls | Observable Phenotype |
|---|---|---|---|---|
| At1g20190 | Clone ID 108362 | ME03210-02 | 22% Increase | |
| | | ME03210-04 | 35% Increase | |
| At1g52880 | Clone ID 21243 | ME12890-03 | 9% Increase | Shorter than wild-type |
| | | ME12890-04 | 9% Increase | Shorter than wild-type |
| At1g55330 | ANNOT ID 867623 | ME13394-01 | 2% Increase | |
| | | ME13394-03 | 21% Increase | |
| | | ME13394-04 | 32% Increase | |
| | | ME13394-05 | 29% Increase | |
| At1g64440 | ANNOT ID 837136 | ME11531-01 | 24% Increase | |
| | | ME11531-02 | 13% Increase | |
| | | ME11531-03 | 14% Increase | |
| | | ME11531-05 | 5% Increase | Dull green leaves |
| At1g68470 | ANNOT ID 868753 | ME17696-04 | 12% Increase | |
| | | ME17696-05 | 13% Increase | |
| At1g74550 | ANNOT ID 521911 | ME07663-11 | 15% Increase | |
| | | ME07663-12 | 12% Increase | |
| At1g76790 | ANNOT ID 869790 | ME20794-01 | 21% Increase | |
| | | ME20794-02 | 11% Increase | |
| | | ME20794-03 | 29% Increase | |
| At1g77520 | ANNOT ID 869854 | ME18127-01 | 4% Increase | |
| | | ME18127-02 | 35% Increase | |
| | | ME18127-03 | 25% Increase | |
| | | ME18127-05 | 30% Increase | |
| At2g04780 | Clone ID 11114 | ME06087-01 | 19% Increase | |
| | | ME06087-02 | 18% Increase | |
| At2g16720 | Clone ID 1006105 | ME04929-04 | 33% Increase | |
| | | ME04929-09 | 31% Increase | |
| | ANNOT ID 858797 | ME17216-02 | 14% Increase | Early bolting |
| | | ME17216-03 | 24% Increase | Early bolting |
| | | ME17216-05 | 7% Increase | Early bolting |
| At2g30490 | Clone ID 41046 | ME01739-01 | 12% Increase | |
| | | ME01739-04 | 4% Increase | |
| | | ME01739-05 | 17% Increase | |
| At2g32990 | ANNOT ID 860676 | ME21595-03 | 23% Increase | |
| | | ME21595-04 | 20% Increase | |
| At2g33590 | ANNOT ID 860791 | ME18822-01 | 35% Increase | |
| | | ME18822-02 | 28% Increase | |
| At3g02210 | ANNOT ID 870466 | ME20615-01 | 14% Increase | |
| | | ME20615-02 | 11% Increase | |
| At4g34050 | Clone ID 8049 | ME01752-01 | 23% Increase | |
| | | ME01752-02 | 12% Increase | |
| | | ME01752-04 | 17% Increase | |
| At4g36220 | ANNOT ID 535161 | ME05326-03 | 17% Decrease | Shorter than wild-type; yellow-orange throughout Mäule section (predominantly G lignin) |
| | | ME05326-05 | 18% Decrease | Shorter than wild-type |
| | | ME05335-02 | 17% Decrease | Shorter than wild-type |
| At4g38400 | Clone ID 38915 | ME01050-01 | 18% Increase | Ectopic lignin in seedling petiole |
| | | ME01050-02 | 20% Increase | Ectopic lignin in seedling petiole |
| | | ME01050-03 | 27% Increase | Ectopic lignin in seedling petiole |
| At5g42100 | Clone ID 11988 | ME00259-01 | 48% Decrease | Late bolting; shorter than wild-type |
| | | ME00259-02 | 44% Decrease | Late bolting; shorter than wild-type |
| | | ME00259-03 | 55% Decrease | Late bolting; shorter than wild-type |
| | | ME00259-04 | 55% Decrease | Late bolting; shorter than wild-type |
| | | ME00259-05 | 62% Decrease | Late bolting; shorter than wild-type |
| | | ME00259-06 | 60% Decrease | Late bolting; shorter than wild-type |

TABLE 3-continued

Summary of the histological analysis of lignin content in transgenic *Arabidopsis* lines

| Gemini ID or Genomic Locus | Construct Code | Transgenic line-event | Change in lignin content relative to wild-type controls | Observable Phenotype |
|---|---|---|---|---|
| At5g47370 | Clone ID 1014844 | ME04199-01 | 15% Decrease | |
| | | ME04199-04 | 20% Decrease | |
| At5g48930 | Clone ID 114130 | ME04941-01 | 13% Decrease | Shorter than wild-type |
| | | ME04941-03 | 15% Decrease | Shorter than wild-type |
| | | ME04941-04 | 17% Decrease | Shorter than wild-type |
| At5g65730 | ANNOT ID 887718 | ME18169-01 | 16% Increase | |
| | | ME18169-02 | 18% Increase | |
| | | ME18169-03 | 21% Increase | |

[1]Nucleotide sequence obtained from *Populus balsamifera*; all other nucleotide sequences were obtained from *Arabidopsis thaliana*.

Ectopic deposition of lignin was observed in the seedling petiole in transgenic line ME01050, which exhibited increased lignin accumulation. The transgenic line ME23571 was observed to have an increased accumulation of lignin and a vascular bundle arrangement that was altered from a collateral type to an amphivasal type. A collateral type is typical of a wild-type arrangement, where the phloem cells are surrounded by cortex cells towards the epidermal tissues and by xylem cells towards the pith. In an amphivasal type of arrangement, the phloem tissues are surrounded by xylem cells. It appeared that some of the cortical cells were converted to lignified xylem cells in plants from ME23571.

Some transgenic lines such as ME23567, ME18779, ME05326, ME00259, and ME04941 were observed to have a decreased accumulation of lignin relative to wild-type plants and a reduced height. The transgenic line ME04199 also was observed to have a decreased accumulation of lignin, but did not exhibit a reduced height. The cylindrical band corresponding to the xylem-interfascicular region was thinner in the transgenic lines ME05326 and ME04941 than that which is normally observed in wild-type plants at the time the tissue sections were sampled. Plants from the transgenic lines ME03210, ME01050, ME02171, and ME12975 were observed to have an increased accumulation of lignin and a cylindrical band that was expanded relative to that normally observed in wild-type plants at the time the tissue sections were sampled.

Example 2

Determination of Functional Homolog and/or Ortholog Sequences

A subject sequence was considered a functional homolog or ortholog of a query sequence if the subject and query sequences encoded proteins having a similar function and/or activity. A process known as Reciprocal BLAST (Rivera et al., *Proc. Natl. Acad. Sci. USA*, 95:6239-6244 (1998)) was used to identify potential functional homolog and/or ortholog sequences from databases consisting of all available public and proprietary peptide sequences, including NR from NCBI and peptide translations from Ceres clones.

Before starting a Reciprocal BLAST process, a specific query polypeptide was searched against all peptides from its source species using BLAST in order to identify polypeptides having BLAST sequence identity of 80% or greater to the query polypeptide and an alignment length of 85% or greater along the shorter sequence in the alignment. The query polypeptide and any of the aforementioned identified polypeptides were designated as a cluster.

The BLASTP version 2.0 program from Washington University at Saint Louis, Mo., USA was used to determine BLAST sequence identity and E-value. The BLASTP version 2.0 program includes the following parameters: 1) an E-value cutoff of 1.0e-5; 2) a word size of 5; and 3) the -postsw option. The BLAST sequence identity was calculated based on the alignment of the first BLAST HSP (High-scoring Segment Pairs) of the identified potential functional homolog and/or ortholog sequence with a specific query polypeptide. The number of identically matched residues in the BLAST HSP is alignment was divided by the HSP length, and then multiplied by 100 to get the BLAST sequence identity. The HSP length typically included gaps in the alignment, but in some cases gaps were excluded.

The main Reciprocal BLAST process consists of two rounds of BLAST searches; forward search and reverse search. In the forward search step, a query polypeptide sequence, "polypeptide A," from source species SA was BLASTed against all protein sequences from a species of interest. Top hits were determined using an E-value cutoff of $10^{-5}$ and a sequence identity cutoff of 35%. Among the top hits, the sequence having the lowest E-value was designated as the best hit, and considered a potential functional homolog or ortholog. Any other top hit that had a sequence identity of 80% or greater to the best hit or to the original query polypeptide was considered a potential functional homolog or ortholog as well. This process was repeated for all species of interest.

In the reverse search round, the top hits identified in the forward search from all species were BLASTed against all protein sequences from the source species SA. A top hit from the forward search that returned a polypeptide from the aforementioned cluster as its best hit was also considered as a potential functional homolog or ortholog.

Functional homologs and/or orthologs were identified by manual inspection of potential functional homolog and/or ortholog sequences. Representative functional homologs and/or orthologs for SEQ ID NO:98, SEQ ID NO:126, SEQ ID NO:136, SEQ ID NO:149, SEQ ID NO:160, SEQ ID NO:176, SEQ ID NO:183, SEQ ID NO:196, SEQ ID NO:204, SEQ ID NO:218, SEQ ID NO:226, SEQ ID NO:240, SEQ ID NO:286, SEQ ID NO:291, SEQ ID NO:134, SEQ ID NO:190, SEQ ID NO:192, SEQ ID NO:342, SEQ ID NO:344, SEQ ID NO:281, SEQ ID NO:284, and SEQ ID NO:289 are shown in FIGS. 1-22, respectively.

Example 3

Determination of Functional Homologs by Hidden Markov Models

Hidden Markov Models (HMMs) were generated by the program HMMER 2.3.2. To generate each HMM, the default HMMER 2.3.2 program parameters, configured for glocal alignments, were used.

An HMM was generated using the sequences shown in FIG. 1 as input. These sequences were fitted to the model and a representative HMM bit score for each sequence is shown in the Sequence Listing. Additional sequences were fitted to the model, and representative HMM bit scores for any such additional sequences are shown in the Sequence Listing. The results indicate that these additional sequences are functional homologs of SEQ ID NO:98.

The procedure above was repeated and an HMM was generated for each group of sequences shown in FIGS. 2, 3, 4, 5, 6, 7, 8, 9, 10, 11, 12, 13, 14, 15, 16, 17, 18, 19, 20, 21, and 22, using the sequences shown in each Figure as input for that HMM. A representative bit score for each sequence is shown in the Sequence Listing. Additional sequences were fitted to certain HMMs, and representative HMM bit scores for such additional sequences are shown in the Sequence Listing. The results indicate that these additional sequences are functional homologs of the sequences used to generate that HMM.

Example 4

Analysis of Lignin Structure and Content in Transgenic *Arabidopsis* Lines

*Arabidopsis* overexpression lines (ME lines) were grown in batches in the greenhouse under long-day condition at 28° C. until senescence stage. Each transformation event corresponding to an overexpression line was planted in several pots (represented as replicates) with each pot randomly distributed in separate flats. The corresponding wild type non-transgenic control for each batch was planted in the same manner. At the senescence stage, stem tissues were divided into three parts (bottom, center, and upper) and were collected separately. Collected tissues were dried in a freeze dryer for at least two days before milling.

Pyrolysis GC-MS was performed on a Py-2020 is pyrolyzer (Frontier Labs, Japan) coupled to a QP2010 GC-MS (Shimadzu, Japan). Finely ground material (2 mm minimum) was weighed out (3 mg) into a deactivated stainless steel cup. Sample was introduced into the pyrolyzer set at 500° C. by gravity. The interface between the pyrolyzer and GC inlet was set at 300° C. Separation of pyrolysates was performed on a GC-column (VF-5MS, 30M×0.25 mm×0.25 um). Helium flow through the pyrolyzer and column was set at 1052 mL/min and 1.0 mL/min respectively. Inlet split ratio was 700:1. Column temperature program was initially set at 70° C. (held for 4 minutes) at a ramp rate of 20° C./min to a final temperature of 350° C. Mass spectral acquisition was at 3333 amu/sec from 50 amu-300 amu after a 4.5 min delay.

The areas of the peaks corresponding to different types of lignin monomers (i.e., H=p-Hydroxyphenyl monomer, G=Guaiacyl monomer, S=Syringyl monomer) and to levoglucosan and furfural (both as cellulose markers) were collected. Total lignin is the sum of all the peaks for H, G, and S monomoers. The ratios shown in Table 4 were normalized relative to total lignin.

Comparisons of overexpression lines were made relative to the wild-type control for each batch. The overexpression of the following clones or genes (as indicated by Annot IDs) leads to relatively higher S/G ratio (generally indicative of a positive parameter that may enhance conversion of biomass to ethanol) as shown by their corresponding ME lines: 38915 (ME01050), 108362 (ME03210), 11988 (ME00259), Annot 869854 (ME18127), and Annot 869790 (ME20794).

The overexpression of the following clones leads to lower cellulose/lignin ratio (indicating either an increase in the absolute amount of lignin or decrease in cellulose) as shown by their corresponding ME lines: 11988 (ME00259) and 8049 (ME01752).

TABLE 4

| Batch | Annot ID | Clone ID | SEQ ID NO | Transformation Events | H/Total Lignin Ratio | G/Total Lignin Ratio | S/Total Lignin Ratio | S/G Ratio | H/G Ratio | Amount of Cellulose/ Lignin |
|---|---|---|---|---|---|---|---|---|---|---|
| 1 | 1493072 | | 358 | ME23571-01-B | 0.11 | 0.62 | 0.26 | 0.42 | 0.18 | |
| 1 | | | | ME23571-03-A | 0.12 | 0.62 | 0.25 | 0.41 | 0.19 | |
| 1 | 535161 | | 98 | ME05326-03-B | 0.10 | 0.44 | 0.45 | 1.01 | 0.23 | |
| 1 | | | | ME05326-05-C | 0.11 | 0.46 | 0.43 | 0.94 | 0.25 | |
| 1 | | 38915 | 286 | ME01050-02-B | 0.12 | 0.61 | 0.26 | 0.43 | 0.19 | |
| 1 | | | | ME01050-03-B | 0.11 | 0.62 | 0.27 | 0.44 | 0.17 | |
| 1 | | 108362 | 222 | ME03210-02-A | 0.11 | 0.61 | 0.26 | 0.43 | 0.19 | |
| 1 | | | | ME03210-04-A | 0.12 | 0.60 | 0.26 | 0.43 | 0.21 | |
| 1 | WT Control | | | WT | 0.10 | 0.64 | 0.25 | 0.39 | 0.16 | |
| 3 | 1493072 | | 358 | ME23571-01-A | 0.13 | 0.60 | 0.27 | 0.44 | 0.22 | 0.11 |
| 3 | | | | ME23571-03-B | 0.13 | 0.57 | 0.30 | 0.53 | 0.23 | 0.12 |
| 3 | | | | ME23571-04-B | 0.14 | 0.59 | 0.27 | 0.46 | 0.23 | 0.10 |
| 3 | WT Control | | | WT (WS) | 0.15 | 0.56 | 0.28 | 0.50 | 0.27 | 0.12 |
| 4 | | 11988 | 281 | ME00259-05 | 0.09 | 0.70 | 0.20 | 0.29 | 0.13 | 0.03 |
| 4 | | | | ME00259-06 | 0.15 | 0.61 | 0.25 | 0.41 | 0.24 | 0.14 |
| 4 | | 8049 | 291 | ME01752-01 | 0.11 | 0.67 | 0.22 | 0.33 | 0.16 | 0.11 |
| 4 | | | | ME01752-04 | 0.09 | 0.68 | 0.22 | 0.33 | 0.13 | 0.05 |
| 4 | 869854 | | 192 | ME18127-02 | 0.15 | 0.61 | 0.24 | 0.40 | 0.24 | 0.13 |
| 4 | | | | ME18127-05-99 | 0.11 | 0.66 | 0.23 | 0.34 | 0.17 | 0.09 |
| 4 | 869790 | | 190 | ME20794-01 | 0.10 | 0.70 | 0.20 | 0.29 | 0.14 | 0.10 |
| 4 | | | | ME20794-03 | 0.16 | 0.61 | 0.23 | 0.38 | 0.26 | 0.12 |
| 4 | 867623 | | 176 | ME13394-04-A | 0.10 | 0.69 | 0.21 | 0.31 | 0.14 | 0.09 |
| 4 | | | | ME13394-05-A | 0.10 | 0.68 | 0.21 | 0.31 | 0.15 | 0.08 |
| 4 | WT Control | | | WT (WS) | 0.10 | 0.68 | 0.22 | 0.32 | 0.15 | 0.09 |

TABLE 4-continued

| Batch | Annot ID | Clone ID | SEQ ID NO | Transformation Events | H/Total Lignin Ratio | G/Total Lignin Ratio | S/Total Lignin Ratio | S/G Ratio | H/G Ratio | Amount of Cellulose/ Lignin |
|---|---|---|---|---|---|---|---|---|---|---|
| 5 | | 11114 | 226 | ME06087-01-A | 0.11 | 0.69 | 0.20 | 0.29 | 0.16 | 0.11 |
| 5 | | | | ME06087-02-A | 0.11 | 0.69 | 0.20 | 0.29 | 0.16 | 0.11 |
| 5 | WT Control | | | WT (WS) | 0.11 | 0.69 | 0.20 | 0.29 | 0.17 | 0.12 |
| 6 | 535161 | | 98 | ME05335-02-B | 0.12 | 0.62 | 0.26 | 0.41 | 0.19 | 0.11 |
| 6 | WT Control | | | WT (WS) | 0.12 | 0.64 | 0.24 | 0.38 | 0.19 | 0.11 |

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (820 sequences)

SEQ ID NO: 1 - DNA, 1823 bp, Arabidopsis thaliana
  misc_feature (1)..(1823): Ceres Promoter 21876
gtctcttaaaaaggatgaacaaacacgaaactggtggattatacaaatgtcgccttatacatatatcggttattggccaaaagagctattttaccttatggataatggtgctactatggttggagttggaggtgtagttcaggcttcaccttctggtttaagccctccaatgggtaatggtaaatttccggcaaaaggtcctttgagatcagccatgttttccaatgttgaggtcttatattccaagtatgagaaaggtaaaataaatgcgtttcctatagtggagttgctagatagtagtagatgttatgggctacgaattggtaagagagttcgattttggactagtccactcggatactttttcaattatggtggtcctggaggaatctcttgtggagtttgatatttgcgagtataatctttgaacttgtgtagattgtacccaaaaccgaaaacatatcctatataaatttcattatgagagtaaaattgtttgttttatgtatcatttctcaactgtgattgagttgactattgaaaacatatcttagataagtttcgttatgagagttaatgatgattgatgacatacacactcctttatgatggtgattcaacgttttggagaaaatttatttataatctctcataaattctccgttattagttgaataaaatcttaaatgtctcctttaaccatagcaaaccaacttaaaaatttagattttaaagttaagatggatattgtgattcaacgattaattatcgtaatgcatattgattatgtaaaataaaatctaactaccggaatttattcaataactccattgtgtgactgcatttaaatatatgttttatgtcccattaattaggctgtaatttcgatttatcaatttatatactagtattaatttaattccatagatttatcaaagccaactcatgacggctagggttttccgtcaccttttcgatcatcaagagagtttttttataaaaaaatttatacaattatacaatttcttaaccaaacaacacataattataagctatttaacatttcaaattgaaaaaaaaaatgtatgagaattttgtggatccatttttgtaattctttgttgggtaaattcacaaccaaaaaaatagaaaggcccaaaacgcgtaagggcaaattagtaaaagtagaaccacaaagagaaagcgaaaaccctagacacctcgtagctataagtaccctcgagtcgaccaggattagggtgcgctctcatatttctcacattttcgtagccgcaagactcctttcagattcttacttgcaggttagatattttctctctttagtgtctccgatcttcatcttcttatgattattgtagctgtttagggtttagattcttagttttagctctatattgactgtgattatcgcttattctttgctgttgttatactgcttttgattctctagctttagatccgtttactcgtcgatcaatattgttcctattgagtctgatgtataatcctctgattaattgatagcgtttagttttgatatcgtcttcgcatgttttttatcatgtcgatctgtatctgctctggttatagttgattctgatgtatttggttggtgatgttccttagatttgatatacctgttgtctcgtggtttgatatgatagctcaactggtgatatgtggttttgtttcagtggatctgtgtttgattatattgttgacgttttggttgttgtatggttgatggttgatgtatttttgttgattctgatgtttcgatttttgtttttgttttgacagct

SEQ ID NO: 2 - DNA, 1000 bp, Arabidopsis thaliana
  misc_feature (1)..(1000): Ceres Promoter PT0668
atagagttttactatgcttttggaatctttcttctaatgtgccaactacagagaaatacatgtattaccactaggaatcggaccatatcatagatatcaggattagataactagttctcgtcgctatcacttcgcattaagttctagtaattgttaaagattctaattttttactaaacaaaaactaaatcaacatcaaatatgcaaagtgtgtgttgtccacacaagtgactcaaagtatacgcaggtgggattggaccatattattgcaaatcgtttccgaaccactcatatttctttttttctctcctttttttatccggagaattatggaaccacttcatttcaacttcaaaactaattttttggttcagtgatcaaatacaaaaaaaaaaaaaaagttatagatattaaatagaaaactattccaatcttaaaaatacaaatgaaaccataattttaatttatacaaaactatttaattagctaagggttgtcttaacgtttagaaaataaaaaattatgattgtctgtttaaaattacaatgaatgaataaaaaaaatatgcaatgaatgaaagaataaattttgtacatccgatagaatgagaaaatgaattttgtacaaaccactcaagaattcaaaacaattgtcaaagttttcttctcagccgtgtgtcctcctctcctagccgccacatctcacacactaatgctaaccacgcgatgtaaccgtaagcgctgagtttttgcatttcagatttcacttccaccaaacaaaactcgccacgtcatcaatacgaatcattccgtataaacgtctagattctttacagcctacaatgttctcttctttggtcggccattatttaacgctttgaacctaaatctagcccagccaacgaagaagacgaagcaaatccaaaccaaagttctccattttcgtagcttctttaagctttttcagtatcatagagacacttttttttttttgattagaa

SEQ ID NO: 3 - DNA, 1000 bp, Arabidopsis thaliana
  misc_feature (1)..(1000): Ceres Promoter PT0535
ttagtgaaattatgacattaagtaaggttttcttagttagctaatgtatggctattcaattgttatgttaggctattttagttagtatatgaatttaggcagtctatgcaaatgatttcgttttcattttttcatatgtaaacatcaagatcaagtaacgccattcgagttgatattttttttttaaattagtgtgtgtaaattttggaccgcttatttgagtttgctaatgaagttgcatatatattacgttaaaccataggcaaactaatttgaaacatccgattcgatttcctgtaatttttcttggttaattgaccaaaatcaagatcttcagaaataaaataaaagacgaaagaaagctgtcgcaaagcagattgtgttaaaaaaaagtggattgggctcaaacgcaacttgtccagcccgtgacaattaccctatacgcaagtaagagtaacgtatcactggcaaaagttggtattagttacgatatctttgtcatgggggcatgcatgggcatggcttaagagttaagccttaagaagagtcccacactcgtgactctcatgatcacttgttgtttcttacgggcaaatacatttaactttattcttcatttattcacctatattcttttggataataacttttctctatataaaataacaaacatcgtacgtttcatttatttacaacaagcgatgagaattaaaaggagaccttaattgatgatactcttcttttctctcggttacaacgggattattacagataatgataatctatatggatgctgacgtggaaaaacaaaatttggtgaaacacgtcaattaagcacgacttttccatggctagtggctaagatcgtttcatcacatggctatatcatataatacttggatgaattcaaaataaacgactgagaaaatgtccacgtcacggcgcaccgctttggacttaagtctcctataataaatacaacaccaaacattgcattcca

SEQ ID NO: 4 - DNA, 999 bp, Arabidopsis thaliana
  misc_feature (1)..(999): Ceres Promoter PT0585
tgaagtcatttaatatgagtttgacattaggtaaacctaatctatgagattatagaatgtagcaaaactatcaatgtttcttttccaaaatattttgtggtttttctttttggttcattatgttttgttatttgtgaattattttaatatgaagtaattatattgattttatatgatatacatattattttgatataaaatttaacacttatccattaaaatagcatgggcataatcaaaatcgggactattacgatgaaaaagatagttaaattgtatgataaaataaaatgtgtaagattaaaattttgggttttagaaaattactaaacaaaatatagacaaagtatgttgactattatttaaaatttaaatatcatcaataagatatagttaaagtcattaagtgtatagcaaaatgaaaattctaagattaaaattcgattaaaattttttttactaaattaaatatttaaaaatagggattatcatttactatttacaattctaatatcatgggtaaaaattgataactttttttaaacccgcctatctaggtgggcctaacctagtttactaattactatatgattaacttattaccacttttacttcttcttttttggtcaaattactttattgttttttataaagtcaaattactctttgcattgtaaataatagtagtaactaaaatcttaaaacaaaatattcaacctttcccattattggaatggtaatgtcttcaacaccattgaccaacgttaaggaatgtcttttaatatttttggaacctaaatgctaatactgtataccacaatcacttatgagtattgaagttgagatagaggaggtacaaggagaccttatctgcagaagacaaaaagccatttttagcaaaactaaagaaagaaaaaagattgaaacacaaatatgcgccactcgtagtccacccctatctctttggcaaaagccacttcactctttttccctttttat

SEQ ID NO: 5 - DNA, 1000 bp, Arabidopsis thaliana
  misc_feature (1)..(1000): Ceres Promoter PT0613
ttaatactaacattgtagaaagccacaaaaaagaaattgaaatgtgagtagatgctgagtcagaggtttggtcaatacacaacagctaattgagataatattatacacgtcacgatgacttgttttttctcctcccaacttgttaatttctttattcttaaaattaaaccatcgcaaaaacagaagaacacagctgtttttctcgactcccaatttctattttgctgctaaggacatttcatttcattatttcccaattcaggactccttagattttcctaaatttgttttcctaacttgctctctctcattctaacattttctcatttttttagattatcttgtactttttagtagattattttatcaggttttacaaacatacattgacattctaaaaagggcttctaaaaattcagtgtggaatgctgatatactaaaaaaaggtcatgcaaaattatctacgatttatctaaaattagataatttgccatatataactattaactaataatcgatcctttgattttttgtttagataaaacgaaacagctatatcttttttttttgttatcggattttaatcgaataaaagctgaaaaataacagttatatcttcttcttttttaactaatgaaacagttatatcttaaacaaacaacagaaacagtaaaatattaatgcaaatccgcgtcaagagataaattttaacaaactaataacaattgagataagattagcgcaaaagaaactctaattttagagcgtgtaaacacaaacacgtcttgaaagtaaacgtgaattacacgcttctaaaacgagcgtgagttttggttataacgaagatacggtgaagtgtgacacctttctacgttaatttcagtttgaggacacaactcaagttatgtttgatatctaaggacttgcactgtctccaaatctgcaggaaggactttttgattggatcaatataaataccatctccattctcgtctccttc

SEQ ID NO: 6 - DNA, 351 bp, Arabidopsis thaliana
  misc_feature (1)..(351): Ceres Promoter PT0625
gatcatgatcagtttcaactcgctgtgcccacgtgtcgagagatcggcacgtgcctgagctctcagccgctcataaatacacttgtttagtagcaacagtatactatagtagtcctctcctgtttggcttttagcttgcatcgatggatggatggatggatcgcatgagagggcttcgcgaaggtacggaaccttacacaacgcgtgtcctttctacgtggccatcgtgtaggcgtctcgccatgctacgtgtcccggaggatgtctcgatgccaacccttataaatactgttccattccaatcccatcgccacagccagtgcaaatctgatcgatcaagataatcgagca

SEQ ID NO: 7 - DNA, 1022 bp, Arabidopsis thaliana
  misc_feature (1)..(1022): Ceres Promoter PT0633
cccgatcggccttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttcgttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagtttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctataaacttagtgagaccctcctctgttttactcacaaatatgcaaactagaaaacaatcatcaggaataaagggtttgattacttctattggaaagaaaaaaatctttggaaaaggcctgcaggg

SEQ ID NO: 8 - DNA, 1000 bp, Arabidopsis thaliana
  misc_feature (1)..(1000): Ceres Promoter PT0650
catacttaattctaaaaaaacaacacttatagtttataagcagctcttatgataaaaatctttctgagttatagctctgttaaacttgtattcaccccaaaaacggatgtttcatttcttattttttacttggagtattttattgtaatttgtaaaaaaaaatgtaaagtgggggatatcatgaaaaacaacgtcactttgtttggtcacaatatacatttgataaaataatggtcgtcgcgtgatttagttgatttttgttttatcaaccacgtgtttcacttgatgagtagtttatatagttaacatgattcggccacttcagatttgggtttgcccacatatgacataccgacatagaaggttaaatccacgtgggaaatgccaatattcaatgtttggttttcaaaagagaatcatttctttatatgatctcaaaagtatggaattgaaatgactaatgagcacatgcaattggtgctatcttaaaaaccgaacgtctttgaatttaatttgtttttcaccaaaggtacctaatgaaaccctttcattaaaaaataaaggtaacaaacaaaattttgtattggaaaaaacattttttggaatatataatttggtaatagaattatgagcaaaaaagaaaaagaaaagaaagaataatgagcataataaagcctttacagtattactaattgggccgagcagttttgggctcttgatcatgtctagtaatcttaaacagacgataaagttaactgcaatttagttggttcaggtgagctaccaaatccaaaaatacgcagattaggttcaccgtaccggaacaaaccggatttatcaaaatccttaagttatacgaaatcacgcttttccttcgatttctccgctcttctccactcttcttctctgttctatcgcagacatttttgtttatatgcatacataataataatacactcttgtcaggatttttgattctctctttggttttctcggaaaa

SEQ ID NO: 9 - DNA, 998 bp, Arabidopsis thaliana
  misc_feature (1)..(998): Ceres Promoter PT0660
caagtcaagttccaatattctaaggagaaataatagtatactaaacatacattagagaggttaaacttctttttggatttaagtgtgtatgcataggctatttattcttaagtataactattaactgtagctagatttatacaagaaatacataaaactttatgcatgtgaggtagccatgaatatacgtacatgttgcaatcgattatacatgttgtatttggatttctctatacatgttttaacttgtcattctctaagtatatacataccattaatactgtgggcatgagtttatgataagacttttcttttggagaccagttttgttttcctttccacctatatttgtctataggcttcacggtacactagtttacaagtgtttttatatgttctaaataaaattgagattttccggaacggtatgatctgtttgcaaataaggacgtatatataacagtatcaaatatatttgttgttataaggcaataatatattttctgagatattgcgtgttacaaaaaagaaatatttgttaagaaaaaaaaagatggtcgaaaaaggggagtaggtgggggcggtcggcttttgattagtaataaaagaaaccacacgagtgacctaccgattcgactcaacgagtctaccgagctaacacagattcaactcgctcgagcttcgttttatgacaagttggtttttttttttttttttaattttttcatcttcttgggtttggttgggtcactcttcaggtcaggtgtgtaaaaaagaaagaaagaaaagagagattgttgtgttgtaacccctttgactaaaatctaatgaacttttttaacacaacaaaactccttcagatctgaaagggttcttcttctctcttagtctcttcgtccttttattctccgtcgtcgtttcatgatctgactctctggtcttctcttcttcttcttcttcttctattttttcttacttcgtcactgttgtgtctgaac

SEQ ID NO: 10 - DNA, 1000 bp, Arabidopsis thaliana
  misc_feature (1)..(1000): Ceres Promoter PT0665
aaaaaggatgggtaatgggacctattttccccaacatcccacatgcacacttccctctccattctctcacatttatttctttcattctaatttatccattccgtgtgtaacatattcactaataatctcatctcactaactcattcattgattgtgatatgtttatctagaattagtgttttaacactgtgtctacatatgatttccttttcattgtatgtgaacatgttaactcactaatcattttgtattttcgagttaacatgagtctccacttcggtagactaaagtaaagataggtttgagtataataaagtttaaaatttgctttaaaatcaatatttataaataagtttttatcataagtgatttttgtatgttatattggaccttgtataaacagactacagaagaaaattatttatgagaacttgtaatgttagagtggacctcgtataaactaattatgtgggcttttaccataaactatttatgaaaattattatggcccacaccactataactaaagcccacatatttagcagcccagtttcattgtaagagacatgttcgctctggaactagaattttctggtttttgggtatttgttttcttatgtgtagagaaatgatggtaacgattaaatgttgtgtattacaatttacaatggtaagacgattaatatatttacacacaattttgttgttgctgtaacacgttagtgtgtgtgatgatagaatttcataaagctttaactacgaggggcaaaatgttaattctaaatagttgacagcagaaaaagatatgtatacataatataaggattaaaacgtaaataataataaataaggcgagttaaattaaaaccctgttaaaaccctagcttgaaacacatgtataaaaacacttgcgagcgcagcttcatcgccatcgccattctctctctcatcaaaagcttttctccttgattttcgcattctttagagtcttaacgcaaag

SEQ ID NO: 11 - DNA, 999 bp, Arabidopsis thaliana
  misc_feature (1)..(999): Ceres Promoter PT0672
cagccgtaaatcctccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaa

SEQ ID NO: 12 - DNA, 1000 bp, Arabidopsis thaliana
  misc_feature (1)..(1000): Ceres Promoter PT0676
aagatagtacagtttcagtgttttgagaaaaaaagctgaactaaaactaaaatgtttaaggacacaatatttagtttcaattagataattcaacagtttgaacaattttttttttttttttttgaagtcatttatttatacaatgttttaaaacgcattaagcatttaggcagccgacaaacgcctattgtctaactgtaaataggcgcttccacttaggttcatattgcatatttactatatgtgtatagtgacaaaaaccaatatttctcttattttggatgaaggtatagtagttgttaaatgttcaatataattaagcattaatgacaaataaaataaaattaatttagttgataaaaagataatcttataaaaagatcgatgaatagatataatggtttactgaattctatagctcttaccttgcacgactatgtcccaaggagaggaagtaccttaactataattctgaacataattttgtctatcttggtgagtattatatgacctaaaccctttaataagaaaaagtataatactggcgtaacgtaataaattaacacaatcataagttgttgacaagcaaaaaaacatacataatttgtttaatgagatatattagttatagttcttatgtcaaagtacaattatgcctaccaaaattaattaatgatttcaacaggaagtctgagatgatgggccgacgtgtagttacgtttcttgaattgtgagagatggtatttattatactgaagaaaacattatttactaaataaattttcatttcacatcttctgtaatcaatgcgggtagatgaagaagttgttaatacgatggccaaccatatggatctcttttttggcgtttctatatatagtaacctcgactccaaaggcattacgtgactcaataaaatcaagtcttttgtttccttttatccaaaaaaaaaaaaaagtcttgtgtttctcttaggttggttgagaatcatttcatttca

SEQ ID NO: 13 - DNA, 998 bp, Arabidopsis thaliana
  misc_feature (1)..(998): Ceres Promoter PT0678
aattaaatgaaaccgcccctaaattaggagggatttgggtaagtggtaacacattcactggaaacatgtgaagaaaggaggatgtcaagtagctgaaaactcagtatagtaaccaacggcttctcaccaacctttcattaataatttggtcatccctatatttttattcaacattttgtttttcaatagcttagagcaccttaatacctttcagtgtttttttataaaaaaaacaaaaattgggattaatcatcaatccccaaatgtaacgtttacttagattatgttcatttttctatacacacaaatcatattcttttgttttaatcttcgaaaaacgagaggacattaaatacccctaaaaaaggaggggacattactaccaacgtacattaacatgtttgatagcaaacgatttattttgttcgttttgaaaaggggaaagtaatgtgtaaattatgtaaagattaataaacttttatggtatagtaacattttcgaataataagagagggaaaacactcgccattgtcggcaatttagaaccaatattagaagggtttttttagagaaaaaggacttaaaagtttagagaccttaacaacaacttatttagaaatagacatgcttaagttgacaacagcgagtttattttctatatcgaagaaaaatacgaactttttcttaattagatttcgaatgcatgcactatcgagaatcgaccgtcacaagaaaaaactaatatacatactgtacatatctatattcaatattggtggggatgggtttaatgtgtatttataattcatggataaattcacacaataaggtccatgaaactagaaggtaccaaaaataagcattaatgactctttgccacttatatatatgattctctcatagtaccattttattctcccaaacctatcttcttcttcctctcttgtctctctcgctctctctcttctacattgtttcttgaggtcaatctattaaaa

SEQ ID NO: 14 - DNA, 1000 bp, Arabidopsis thaliana
  misc_feature (1)..(1000): Ceres Promoter PT0683
gattgaatgatgagtgtgcacccttgtattactaataaaaaatttagcaacagttataagctaacgtcatccatgagtcattcattagattcactatttgcgttctcaaaaatcgaattgttaaaatttgagaagctctaatatacgagtcaatgagatgtggcaaaagcatgtccttgaccataaaatttcgaggggtcaactcattagataaggacaagaatcaaccaattgaaggcgtcttctataacaagtttctttattactaatattaaagtccaatggggtgagggggagaagaacttaaataaaaggaaataattggtaagtgaataaaatctaaatacgatactagatgattgatttgtgctagtgcatggtattagatcagatatgtgttactattcgaattcaaattggcatattccatgttgttgataagaaaattgtagaagtgtaaaagctgagttactatattcaaactagtggtttacataaagtgagacaacaactgtttcacaaaaatgactataaaatagtaagtagtattaggtcaattgattttaaaattttaatcaaattcaaatttgtgatataatcaaatttgtttatagaaaatgttaagaaatcaattttggcagaactaattcagtgagaaacaatcatttacaaaaacaattttaacattatttaacagtaagatttgacatttaacccgttcgtgtgaacccatcatatctaacatggctctacccatgacgcctccatgccatggacaattttgacagatcagaagttctgaacgtggacgaggtaagaacaccatgatgatacgattggagttagttatgtcgccaccgacatcactgccaatctcattaataaaagtggtactaaatctctaatctctattaactataaatataacaaagaaccaaaagaaagtttcttatctctcttatctttcataatttccaagaaacacaaaccttttctacta

SEQ ID NO: 15 - DNA, 1000 bp, Arabidopsis thaliana
  misc_feature (1)..(1000): Ceres Promoter PT0688
acgttcagaggcatcgcttttgtacaaattgaagcgggtttgttcaatatttaaaataacacaggaaacattcaaatgtattattgatgttgcttaggtttgtgaaatgatatgaaccatatcgtatatattactagatttttcttatatgttttaagggtagtggggctgacctatcattctgtttggcattaccaatcagactatcagagtattcaccattcaggattccataactagaaaaagaaggggtttacattttctcatactgtataattttctactatcagagattttatcgattacattaatctcatagtgattattctgatttataaaaaagttgacaaaataattaaaaccagtattttataacaagattgtctctctcccatggccattattttgacctctgacttatttaaatcttaattaacagcataatactgtattaagcgtatttaaatgaaacaaaataaaagaaaaaaagaacaaaacgaaagagtggaccacatgcgtgtcaagaaaggccggtcgttaccgttaaggtgtgtcgaactgtgattgggccacgttaacggcgtatccaaaagaaagaaagggcacgtgtatagatctaggaaaaaagaaagaatggacggtttagattgtatctaggtaccaggaaatggaacgtcacaccaaacggtacgtgtcggatcctgcccgttgatgctgacggtcagcaacttccccttattcatgcccccctgcccgttaattacgtgtaacccttccatgcgaaaatcaaacccttttttttttttgcgttcttcttcaacttttctttttaaatcaaaccttttctttttaaaatcacattgcatttcctaacgctcaacaaaatctctctctactaatatctctctctctctctctctattgttgaagaagactcataatcggagattgtttgtttttggtttgctctgtaaattggagaagttttgttagagatcaa

SEQ ID NO: 16 - DNA, 1000 bp, Arabidopsis thaliana
  misc_feature (1)..(1000): Ceres Promoter PT0695
aacattttctttaacttactcttaaattttaatagtaagttgatgcatgttatgttgatccgtcttgatcacaaatattgttttatggacgaattctttgacagtaaatggctatagtgactcagcttggagcatcccgatatgaaaacaaagtgcagtattgtgtcgtggtcatcactaacgcactttcctagaactatcgcgcgtgtttgacctatgcaacacaccagatgtcatgaacgtatacttaaatagaaacaatgatatagacaattggctatattctgtcatggaacgcaaaccggataacatgtctattagattcatcggacttgatcatggttatgtcttaatagacgaattctttgttaacgattggttaaaacggctcacgttagagcatcctactatgacttcaaaattgataaatattacatggaaatcactttaattttagttagaaggtagttaatttagatattcttatttaataaattaaaaaatagaagaaaaaaagatgagaagagtttttgtttataaaataagaaatatcttttattgtaattttaaaattaaacaaatttaatttatattaaaattatctttgttttattgttaaggcaataattatttttttggtgggaattgttaaaacaataattagtatactgttaagtggtcctttaataataagataacgtgatttaaaaaagaacgagacaggctaatatagtagagaggaaaaaatacaatttaggcccaataaagcccaatatagagttgtgctcaaacacaggtcttcgccagatttcctatgacgccgtgtgtcaatcatgacgccaagtgtcattcaagaccgtcacgtggcgttgtttctacacataggcgatccatacaaatcagtaacaaacacgaaaagagcattcatatgtacgaaagtagaaaagaagagactctttgtgataaaactaagtaagaaatagcataaaagtaaaaggga

SEQ ID NO: 17 - DNA, 1000 bp, Arabidopsis thaliana
  misc_feature (1)..(1000): Ceres Promoter PT0708
gtttccaaaactagtattctttatttgctctattcattatatttttatatttgtaacgtcccgaccgtctttattaggtttcgacaatcacttctcggaaggtcgtccatcctgaaattactctatcctaaacatgtttaactataaaattctctcgaaacttttgtaacgtatataaccacataaattctcttaaacttatttgcatacaccattatatttctgaaatcgatatgttacaatattatttaatatttagattacttttactgaatcgaattaaatatcaaatcgaaacaaatctaatctaccaaaaataattttgttataaacatttcttgcctagttctacctcatatacattttagttaaagaaagaaatcacaacaattcccataattcaataattaaatccacaaaatcttggagtaagtaagagaaataaaaagatagtatcttaacataaacaattcaaagatgctctctcacacaattcacacacacttacaaaacaaaagacagaaacaatgttttcattcaaatcaaaagaagttataacactagtacaaaaaaagctcaaattctaatagtaactctttttatttcccaattacccaaagattctctctcacttcacaaaactagctttgagagtcgtgttccacaaaatccattaaagctgaaacggttttgctcaccattcaaacaaatacaaaattgcaaaaccccaaattataacaaaataatataaaaattaaaccgctaaaaagagtgaaccaacaaaaatcgccgaatgtgtgtgtaatgagaaaaccgacccatcatcccaatcatctcttcccgtgtcactctcttcctctcccacgtttcttctctcttccctttatgggttttaacttctccttcttcttcttcttcaatcttcagttttcaaattcaacaacaattcacattttgatttcttcatcatctctctctctctcgcttctctctcaaatcg

SEQ ID NO: 18 - DNA, 1000 bp, Arabidopsis thaliana
  misc_feature (1)..(1000): Ceres Promoter PT0710
tagtgcgcgtggggagagggaatggtgaaaccttagtggttaagttatgaggaaaatgataaaaggataaaacaatcaaatgcagcttgaaacggccataacataaagtaccttatggtggtgcgaatatttttgtgtttctttcactcttttattgctgaaagctacgacacttgtcttaatatattgtttccgcaagtcacatgatctactttttatttaacgtctagaaacgccgagatatatgatgattagtatatcacgtctatgcaaattgttagttcgtgtttggccaaaagatatcgagacatgtctgaagaaccgagtctggttttgagatatttcttcaagcattactatacaatagaaaaaggagacacgcgaatatgataatagcaaaaggcataaaaaggcgaaaattaaagaaaaacgtaaagtgatttggcctcaatcaacgggaacgtatcttaattttagaggttcttcttttacttttgagacgagagagtttgcgtctttgcgagctgctttggttgactaaacattatcatattgaaaaccaaaatacaacggaggaatatttgtcacagtttcactttcacattgtttccttaacgtttaatcaaccttgttcaaaatttctatagttgtaatcatcattgtttacaaaattttcgttcaaagatgattttaaataaaattgtgaaagaaaaccttttctgaaataaggattggatgatagtgttaaaagaaaaatatgaactgaggcaaaaagaggagtggtccccggaagattgtgaaatgtgtcatctaaaccagccagacgtagtcacgtgttctctctagctttatgaacttccttagccagcaccatcattgtgattgtagtatatatgtaaccctaccttcatctctcccattttccattctccatatagactcctttacaatatacaaaacctatccaaaagcgaagaagccaagcaaacatattataaaa

SEQ ID NO: 19 - DNA, 1002 bp, Arabidopsis thaliana
  misc_feature (1)..(1002): Ceres Promoter PT0723
gtcatatcttatcaacacgtcaacgatcaaaacctttagcctattaaattcaacggcttagatcaaaacgaaactaggtgggtcccacttttaatatcgtggctgcataacatttcctcgataactgaagccgttgtggtctttctcagaatctggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgttattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttrcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaa

SEQ ID NO: 20 - DNA, 1001 bp, Arabidopsis thaliana
  misc_feature (1)..(1001): Ceres Promoter PT0740
tgtggccactaaagatttacccttaaccgggcccatataagcccacgtcaagtggcgcttatacgctctccgtaagagagccaacatttggtatgtaatgttgcaaattattcttcaagacaataaattcaaatataattcaatattgtccaaatatagtgatgtacttcagttgtgcacatagaaactccactaaaccaacttttagatagatgcattcacaaattttcaacaatgtcgcgaaagtctaatccatcaccagattctaacattttaattattatatttaactatacatactctaatcagcatgagtcaaacgtgtacaatagcccaagcatataataagaccaaagtcaaactcaaataaatgtctccaaactcaaaacttgaaaaagacctaattattacatggtagatatgactttgtcgacaagtaaaccaactaatcctcgaagctaccttctcttcccagttattatgtgtgatcgatttataaatctcttcttctaataacacctatatttttcttatgatgtgaataaatataaaacttttaactttaaaacatatttatccgaaatattgcacttagatttcaaatagataaataatagtactatctaactgatattgaaaagacctaacacggaaaacagttttataaaaaatcccaaatgtgggtaattatcttgatttcttgggggaaacagaaaatggattaagattaatcggagtcgtgtcaagcagctcgttaataactgtagcaagttgactgagtaagcatcaacgtgtcatctccgtaaagcccattatttctagtctcgccgcgtcttctcttccacgtagcacttcactttttctctccttttgtttcctttggaacacaaacgtttctatttataggaataattacgtcgtccgtatctgtgtcggaacatagatccaaattaaaagcgacttacttaattacatatcgttcgtgtttttttcttcaaaaa

SEQ ID NO: 21 - DNA, 1024 bp, Arabidopsis thaliana
  misc_feature (1)..(1024): Ceres Promoter PT0743
tcgattggcccgatcggccccaaaatcaagctgagccgcttcaaacttcagcttttgaaatcacccccaaactcatgtcctcttatcattataactaaaggatctttcattttatttaactcatcgtcttgcactacccaacccaaaggttccaactatacccgaagctttctaaaggtccaaagactttttttttcgagccagactattcaagccaagaaaagccaaaccccacaagccagtacttttcaattccatattataaacttatctgtcttgttttagtcccactaaaaacaacagaatttaatttaggttgagctaaaacccttgacaaaagtgtatagtcgtcgattcagtagcacactcatcactcatcagatttgatagttgacctaaagtatgactactccatttcaactaacaaatgaaaataaaagagacctaagggttagaggattgaaactatactctcaagtcttttatcactaggctactaccagctagttaacttgatggatttaagcaagaaaacgtagaatttatattcgagcagattgtttagctaaaaaagcttgggtttgaaattgccttttctcccatataagcacgtcggttcctaaataactctttctagcggagagtgtctttccaataatttaataaaaatggtgtttgtatatcaaaaaaaaaagaaaaaagaaactgatcgagatagaacgtttgcagttttataaacaatttaaaaaacaaaaaaaattaaactcaatgtattttttattaattcacaaacaataataaatcataggatcgaatatttacacggtatcaaaacctactcgccgctactatataaaaattgaagtcaaatatcaaccgcaattattaaaccagcaagacaataattcataaacttaatataaacataaataaattaatgttacacaacgatatatggtgagggttattactatcttcttcctctcaaaacacatctcctaaccttaagctttagacggcctgc

SEQ ID NO: 22 - DNA, 1000 bp, Arabidopsis thaliana
  misc_feature (1)..(1000): Ceres Promoter PT0758
agctagccacatcagtgaccaaaaaagataattaacaaaccaaataaaataacaaattttgatcatttggaataaaatttataaaaggaacgaaagcgccttctcacgggtcccatccattgaaatatattctctctttttgctctatataataataacgcgtactaatttgtagtatatattattacaaagtcgatatttgattgttttgtgaacgttgatatattaattttcttggatgatgacaaaaaaagtcatagaaagtaacgtgtgaacatagcattaacaaaatacaaacataatatataaccaaatatatgaaaataggataaaatctcattgaatagatcttcttctattcaaatatataaatatttgtttgtctataaaattaacagagcattcacattatctaaaataatagtaaaatcaaaataaaactaaataaaaataactctggttttataacgattgattttaaatattagtttttgttgtaaagagatcattatatatgtctgtaatatttttatactgagttacatgatatttagttattatagcgtaattaactaagataagaaattaactaaagtgatattctgattattattatttttgttaggacacgtacgtggaaaaactaaacactataggttacaaaacggtataataaactcaccattactggaaaatgtttgcatttgactcaataagtaacttattataagttactgatataatgcatagttttgaaattcttaaataaattattttggtttcgcatgaaaatatgaaaggagagaaatttattattgtcacttatatatatatacatcgtaatcattttttcgtgaataattctctctcccattccattatttctcagtatctctctttctttcccttactttattgttgcttttaaaccttcaatttgctcataaaccaaatatataatatcaaaacaaacaaacaaaaaatcagaattcccctaata

SEQ ID NO: 23 - DNA, 921 bp, Arabidopsis thaliana
  misc_feature (1)..(921): Ceres Promoter PT0829
aaagttttgaattattgggaatcaatttcgaagttttgtaattctttgggggctaataggatattttattttcttggtttcgtctattgttgtttttctatttatggttgggcttttagaactctggacaggcccatgtcatatgttttcccttctccttatatttttcatttttcattttgttaaattaatgcataatatccaaaaacaatttaaatttttgaaggaaccctttagttacggctccgaagctttcacaagtgagaatgtgagatcaaagaaggcaaatggaggattttaaaagttaaaatcatcttttatctgcaaaagttgacaatttttttgtatcaaatctaaatcatcaaactctcttaaactacaagagcataacaacctctatgtaatccatgaaataatctgcttgaaggacataacataaatcattatggctagagtgactaacttcaatcaaatcctcttaactctagctcccttacaatggtatcgtaaaacattatgcattagggattgttgtcctaggaaaataaaataaaaatccccacagaccaactaccattttaacttaaaaataagcttcgtccgcgacgaattgttttccatcctaaaaatagaatggtgtaatctgctaatggtttagttccattaacttgcaagttctattgaaagcctaaatgtcaataaagatattaaaattcggagtcaaaagacaaatgaatcaaaagcaacaagacaagtcagctccattcttcactacccatcttttacaataaatcatctctcttttcacaaatttcaaactactctcattgccctttagctttgttatagagccaacactacagagagactcacacacttgtttcaataattaaatctgaatttggctcttcttataaacta

SEQ ID NO: 24 - DNA, 763 bp, Arabidopsis thaliana
  misc_feature (1)..(763): Ceres Promoter PT0837
aactacaagggagacataatatcaccatctggttcctgttatcatctgaagatttcttgttttaccttccagtgataaaatgatccttataatacatatagatatattaaattgctgtattttaagattatagatatataaggtacatgagagtgtttatttaaaaaaattcacttggaattcatgttttgtgatacgttagattggaatccatttgggaaaagaagaatcatctgttcttatgtctcaaattttgacttcattcacttttcttcttgtcttttaagaaagcttccacaatctaactgttcgatgtgaaaactgagattcgagtaagaaaatgtgaactgtgttatactgttttttaattagataatttagattgcactcagataaattaataacattcctcgaatacttttatgtgattggatatattaggtatatctgccaaccaaccaataaactgctatgtttaaacaaattaaataaattagtatatgtttactcaagaataaagaagatagaaaagaaaattctatatgagctaaatttgctggaggaggcatcggacgtgggtaccagacctttccaagcacacgagtagtgcttagccatgtcatgctaacatacaccatttggttcatacaaaatccaaatcaaaatctatttttaaaatcttttgcacacgtctttgaaaaacacctctcatactatagctacggaagcttcaatttcaaggtttgtctaaaagctaacgatt

SEQ ID NO: 25 - DNA, 751 bp, Arabidopsis thaliana
  misc_feature (1)..(751): Ceres Promoter PT0838
atactggtatgcttaaggttgaagccaagatctctgtcttacccaagtaaccactttctattagaagggatcaacactaagaatatggagatttaagcctaagggctaaggcggttctcaacaatacatgatgtgaatacaatcacagacgatttactgaggtttgttgataagatcttgatcagtctctgcatcatctgttcaacaatctcaatctttgactgtttgctttcggagccataaacagaggaatcccttattccctgttataggagcaatacaccaagtattatttccatggctgaaattctcttatggaaacctaattgttccattgaagctgtaaaatcgaatctggtgaatattctcgagcaaagccgcatgctaattatgtcaattcagaagagtttgattaggagactcgaagcgagtttgatgatctttcttgatgttcaactccgattgtaagggtataattgacttttcatgtattacggctccaccacctgacactaaggcactctttgtccatctcgttggtatcatcggattcggatggtaaaaataaaaagagcagaggaaacttgttactcatgcaagcttctcaggtgccacgtcactccattacgtgtcatcttcacacaccatctcgctcaaaaccgatctcatttttcaaaccttaaaggcagaagcaactgattaagttaacactcttgagaagctctcgattaagcttgaacttggaggatca

SEQ ID NO: 26 - DNA, 669 bp, Arabidopsis thaliana
  misc_feature (1)..(669): Ceres Promoter PT0848
tctctttaaatcagttaactaaccgtttatatatttacgataaggtttgaagagattattgataaaataatacatttcataatcccgcgttcaaccgtttaaagtaacatttaagttgactatatctaattttttttccattaaatatggagctggtaaactttatcaacttctaaaaagtgtaacaacaaaaattaggtcaatcacaattctgttttttttattattttggattgacttccaattgcaaatagtcttagtgatcaccattatcatacatatatacatcaagtaggtttcatcatgatataccacaaagtatttgacaagccatatggttttggatcaaaaagtcggtccaaaattaatgttttatgtgcaagaaccgacccattgtacacacgtgttaacatcttcaagactttcatctctatttttcttttggtcattaagatacccattgatccgaatctgttacattcccacctacttttttaatttttactatccactccaaattaaacacaaccgatgattttaataattggaagcttttaaaaatatttcaaaacaagcctctttgtgtttgtctatatatatacacgtaataagaaggtgaatgaatctcacagcttacttgttctaaggcttccaataacgaaaacagta

SEQ ID NO: 27 - DNA, 702 bp, Arabidopsis thaliana
  misc_feature (1)..(702): Ceres Promoter PT0863
cgggaaacgacaatctgatctctagtccagtcgattggcccgatcggccgattataaacttacatgagacaagtataaataattattataaacttattaagtttaagatcaaggcttttgtgcaatgtatcaatgaatgttagatgtgatatgatgaaagcaatgttttaaacacatacatagtcattgatcggaatgtgtgttattagaaatgcatgcctaagccgatagggttatctatgtttggtcttggacattatagccaaatttcgaatctaattcttccaatatatatttttttttttttgcttagggccactactagtattgcttatcaattttaagagctcatgaaaatgcaacaatatagtagttgcaaatccttgtttcaagagaaatcaaagggccacttgtgaattgaataataataatatttgcaaataacctttcactaaaccataccaacaaaaccacacagatttggcaaagacataacctttgggagacgtgaaaaggctcaaaatttgacaattgtccttacaaattcgctcattagtgcaattgtgagatttgtttgcatccaaatccaattcataactcacactcgtctcaaattcgaaaaggcctgcagggccagtgcactgggatccaacaatgtcctccgactcgtccaagatcaagaggaagcggaaccgcaccgcg

SEQ ID NO: 28 - DNA, 435 bp, Arabidopsis thaliana
  misc_feature (1)..(435): Ceres Promoter PT0879
ttctaggaagactggtcaagctaagctgtttctgttttttgtttttgtactttactttttgtttgctagtgggaactgggtttattgggccttgaagttgataaaagatgaataaaagacatatcgcctaaagcccatatgagaagcagaagacaaaaacctccaactttgggcataaattttgattatagttaaaagtccagacccaatttggcacctggcttagttacgattctaaggcatgacacctgcctaatatgtttattacagaaaataaagagaatcagctaggtgtcccttattgaacacattaacaaactccaacgacactacgtgtcttcgtgactcttactatatccaaaaacctatagctaaagctgaattttccatgattagtatagtcccaaccaaaaaaatactgaagaaggcataagc

SEQ ID NO: 29 - DNA, 397 bp, Arabidopsis thaliana
  misc_feature (1)..(397): Ceres Promoter PT0886
agtgtatttgaaaacgacattgaagaattaatatatttttttttaattttagttttttatagtacaaatattaaaacaaacaatcctaccatatcataacatttgtaaataacattttaagttttgttttgagttttaattaattttctatgacaaaaaaatgaagtcaatagactaagtgaatcatatagtataaataaacacaatttaaatagtttcaaataaatttagaaagaataaaacaaatagaaatcagaaggtgtctgtttcctcctcgcaacatacgatcaaagagaaacaacttgaccctttacattgctcaagagctcatctcttccctctacaaaaatggccgcacgtctccaaccttctcccaactccttcttccgccatcatc

SEQ ID NO: 30 - DNA, 1024 bp, Arabidopsis thaliana
  misc_feature (1)..(1024): Ceres Promoter YP0007
agcagaacaactatatttattgtgtcacataaatctgagatcatttataaccaccaaagaacctatacacagtaaatgacaaatgtatctccctctatctctattgcccatatgtagatgctaaagtaagatttctcttttttttaatgtacttttttttgtataaagtatattccataagaaaaaggaaaagcttgtttatggatcaattgaccccaaaaaaagtttttagatcaaagcccaatataaaaaaaaaacacagtagtgacacaaaggaacttaaataaaccatgaattgatctataaacagtagagatcgataaggcgaacattttccatgtgaagtgtcttctttcatctataatatttttgacatccaataatttcctctataatatcattcacataattgatagaaacattatgttagaattgtccacatcatttgagctgtaatatattctgttttaacaaattatatggtagttgcttaatcttatgtccatcttcttctatgcatcgttttcgcgcctagttgtccagtccatttcaactacctacctctaattcttatcttaaaacaacattttttaatttaagtattatgctcaaagactaactagatagaaaaccgttattaaacattaaacgaattaaaagtcttacatggaaaatgtaggtttataaaccacgagttatgattgacaataaaaaaaatgcaaatcatcaatcaaaagagacttgagtgcgactctatatcaaccattgcaattaaaattatctatcacaaaaattttagacagattaagttaatttagtctaaattcactaatttattttctataattagtaattaactatatttatttatttacacattttctgataatttagaaatttgcatgaataacaaatataagattttggaaattagtagcaaatttaattaataattatttttgcctaaatgaaccaaactataaaacctccacatacaccagtcatcaaatttacagagacaaca

SEQ ID NO: 31 - DNA, 1000 bp, Arabidopsis thaliana
  misc_feature (1)..(1000): Ceres Promoter YP0008
ctcgagagatgaagtcttagtaatgtttgaacaaacaataatcacgttttccatcaaattcgagcatttaaagtttatattactacatgccccaagatgataccgtccatctcatccgaaaatatttctgaaattgcgctaagacaacaatgtttgctcaaattcgatcatttaaagtttacaaatctctcatcaatcttacaaacttctcacactaaacagaggtacatattttcttataaagacaaaaggttcgaacagctggcttctcaactcgagttgtttgtcagggcctctcttcactaactacaagttggtacttcaaatattggtggctagcttcacgtgatattgtctacaaattaaacccatgaaaaagctgcattaattgttccaagtgaaccctgaggagtgtcaatagtctttgctttagtgtgatcattaaaccaaatctctaaattcctaatttgtactaacatttggaacgtatttcctactcttctccctgctccaactcccaaaaataagattagttagatttctataactaatatacatgtatactcccaaaaacagtaaaaccatattaataaagctaattttgcatagatttatttcggtaaaccggcggttcaagttggggaaaaaaaagacaaacggtctaaagtcatccaaagacaaaaaaccaaagacaagttgagagagacgagaccaatcacaacattgcttcgtagattgcgtgacatcatccttgacggctactttcatttgtgtcttatttggataaaacgcacgtgtttaattcacgaaccttcatagcaataagaaatttccattactttcatattttcaactttttttattacccattacatgcttaaaatattaattcacaagtctttgtcaaaattcaatattttccaggttcatgaaccctttttatctcaatctactctataatatctccctataaattacaacaaaacctctttatttttca

SEQ ID NO: 32 - DNA, 999 bp, Arabidopsis thaliana
  misc_feature (1)..(999): Ceres Promoter YP0019
gatataagtagaatcattttttgccgccgtttctcgctaacacaccgaaaactgaatcaaatctcctagctcttctacgcaaaatcgagtgcatcgacaatggcggaacgtggtgtcgaacgtggtggagatcgcggcgatttcggacgtggattcggtggtcgcggcggtggaagaggtggtccgagaggtcgtggtcgccgtgcaggtcgtgctccagaggaggagaaatgggtgccagtgactaagcttggtcgtctcgtaaaggaaggtaagatcacaaagattgagcagatctacctccattctctcccagtcaaggagtaccagatcatagatttactcgtcggtccttcattgaaagacgaagtgatgaaaatcatgccggttcaaaaacaaaccagagccggtcagagaacgagattcaaggccttcatcgtcgtcggagatagtaacggtcacgtcggattaggagtcaaatgctccaaggaagttgcgacggcgatcagaggcgcgatcattctcgcgaaattgtctgtggttccgatacgaagaggttattggggtaacaagattggaaaaccacatacggttccgtgtaaggtaaccgggaaatgtggatctgttactgtacgtatggttccagctccgagaggttctggtattgtggcggctagagttcctaagaaggttcttcaattcgctggaattgatgatgtctttacttcttctagaggatccaccaaaactcttggaaacttcgtcaaggtatgtactttcacaatggctgttttggtttgatgaactctgaattaggcagtgaaaaagtaatcattaccagttaagtgaatttatattgaagattaggatttagctgattgtattggtttgagcatgtgagtttgtgtttaagattgcttgaattgaaatgctttaggttgtttgattacgctaaattctgactaatgtaattcaaattgttgttgtttttttttggtc

SEQ ID NO: 33 - DNA, 1024 bp, Arabidopsis thaliana
  misc_feature (1)..(1024): Ceres Promoter YP0028
gtcagtgaagtcgattggtagtacttgaaacacttggttggtttcatgtatttggcctatatataaacaaacatcgtaattatatacggatttttttcggaattttacgccatatctgtaagtatatataacatgcatgtcgttttcaaattcatatgatgaacgatccacgtaagtgctactactcctacaatattgcatgagagagatatgtatttataaattttattttgaagaagaaataagagggaaggttacttgggtggatcgatgtgaaaacaaaagaagaaaaagcgaaacccactaagccattacatgatatcgaccttcttatctttttcctctttattttatttttctcatcttctttttgtcaggacttttttctacttaatgaaacctccaaactatctaactaatacactcccatgtagaataaagaaaattatataagatattgttgatattttgtaactagaaaatatatttgctctgtaatttttcgtaagttaaatcaacattttaaagtagaaacaaatattactgcaaaaagtaggatcattatttttgtccaaaatctcagttagctatagggttgtagtaaaaacaaaacacattcttgatttgccccaaaaaataaagagagagaagaatattgttcaaaagtggtctcttctctctctaattatgttttcactaaacccaattagattcaaacagtctacaaagtccaaaagataaacatgggacaacaattcgatgcaaaaaatcctcttttcatgctctttttttattctctagtcttttaaattactaataaaaactcacaaatccaccaaacccattctctacaactcaccttcatctagatttacccactcccaccgagaaacacaagaaaaaaaatatacatatataaatatacaagacaacacatgatgctgatgcaatatacacaacaaagtattaaatcttagatattgtgggtctccctttcttctattcattttcttattcattaaaa

SEQ ID NO: 34 - DNA, 1024 bp, Arabidopsis thaliana
  misc_feature (1)..(1024): Ceres Promoter YP0039
ccgttcgagtatttgaaaatttcgggtacacccgcctaaataggcggaccttatctagtatatatatacatttgaactatattgtttactttttagttgatttaggctatgtcatgacattgacataaatctacctgttatttatcacgtgtaattcgtgtaaagtgtaaactagaaagttcaaatacgtatttgtttttgttctgttatataggattgtcatagttgtaaatctacaatttattacaacatgaataagtacacaagcaatgtaattggatttaattgctaaactctttacatggtcaatctaaatttgataagaaatacgtcacatattactaagactgatagtttttttgttgtcaccaattatttttgttaaattgacgaaaacaattccaaaaactcaaatgtacaaaatcatacagtctcacaaacatctcatagagaaagatataaatctcccatatgggaacgataacacgaggtcgaaatactattcgtaaaactaaaacgccttagttataaatcgttagttgtaaccgcggtcgagaatacatacagatccacgaaactactactacacatgctgctgaattggaatttggaaaagaccatcttctttaggaagagctcacccaatgagtgacaaaggtgtcggtggcttgttttctacccatatgtatacatcaaatggtagtttcattaacgtttggttttgagaaaagtaagactttggctagtagctaggttcgtatataataaactcttttgagaaagttcatcactggtggaaaatgttaaaccggttttttctcattttttccgccatgttaaccaccggtttaaaaagaccgtaacacattgaaagattaataagggtatatttgtaattacggtttgctggcaatttttaattattattttaattagagaaaatagagaagccctatcaatgtacatggtatatatataaaaggcaaaaccctagaaaacgatactattcgactcagccgtcctt

SEQ ID NO: 35 - DNA, 1024 bp, Arabidopsis thaliana
  misc_feature (1)..(1024): Ceres Promoter YP0050
aatctgatctctagtccagtcgattggtacttgagggaaacatcatatttttaaaccttgtctcagtaagctaacacacaccccttgtgattacttatccatgtttatccacaagaatgcagttggattgagatattttcttctttgttgaaatcaggcctcaaggtgttcatgtggtctgcaaaaaaattcccaaaaataaagatagtgacatctgaaatcgataatggattagacgaagagtttcgtgttattccttggtatgggcgggtttggggacagatattttggcacagacgaggactaggccactgtggtcctgcagcattaggtgtcccttccatgtcctgcattacattttattgatggattcatcaccctatctactacaacggctacacaaactatgaagagttttgtttactaataaatgcccaagtgaggggtcgatcgaacccgggacacgtttttcagtttaccatatagaattatccttggaacccttgatactccatagaacatcaccacctctgttgtcatctcaggaatccaggttcaaacctagtctctctctccctagtgggaggtatatggccactgggccaatgatgacaaaatgcaaaaaaaataaaatacatttgggttcattatctaaaatatctcttgtgtttgtaagttttggttgcacactcgtgtggttgaagtgtgtgtgagaggtactatacaatacactctgcttttgttttgtacctatctctttctcttctccacatatccaagactttggggataaagctgagatcattggttgccatttggttgtgtagaagcaatcacccatttgctttatccgaggttgataaatttcctcgggttctccttctgacacgtatgacaaattctaatagtatattcctcgtagatattacctatatattctcaatagttgcaggtacttaaggctttgtcttggcatcctcgtcctcttcagcaaaactcgtctctcttgcactccaaaaagcaa

SEQ ID NO: 36 - DNA, 999 bp, Arabidopsis thaliana
  misc_feature (1)..(999): Ceres Promoter YP0086
cttatcctttaacaatgaacaggtttttagaggtagcttgatgattcctgcacatgtgatcttggcttcaggcttaattttccaggtaaagcattatgagatactcttatatctcttacatacttttgagataatgcacaagaacttcataactatatgctttagtttctgcatttgacactgccaaattcattaatctctaatatctttgttgttgatctttggtagacatgggtactagaaaaagcaaactacaccaaggtaaaatacttttgtacaaacataaactcgttatcacggaacatcaatggagtgtatatctaacggagtgtagaaacatttgattattgcaggaagctatctcaggatattatcggtttatatggaatctcttctacgcagagtatctgttattccccttcctctagctttcaatttcatggtgaggatatgcagttttctttgtatatcattcttcttcttctttgtagcttggagtcaaaatcggttccttcatgtacatacatcaaggatatgtccttctgaatttttatatcttgcaataaaaatgcttgtaccaattgaaacaccagctttttgagttctatgatcactgacttggttctaaccaaaaaaaaaaaaatgtttaatttacatatctaaaagtaggtttagggaaacctaaacagtaaaatatttgtatattattcgaatttcactcatcataaaaacttaaattgcaccataaaattttgttttactattaatgatgtaatttgtgtaacttaagataaaaataatattccgtaagttaaccggctaaaaccacgtataaaccagggaacctgttaaaccggttctttactggataaagaaatgaaagcccatgtagacagctccattagagcccaaaccctaaatttctcatctatataaaaggagtgacattagggtttttgttcgtcctcttaaagcttctcgttttctctgccgtctctc

SEQ ID NO: 37 - DNA, 1024 bp, Arabidopsis thaliana
  misc_feature (1)..(1024): Ceres Promoter YP0088
tcgattgggattactacttcatctagtaaggttctgaaaacgtttgttgttgataaggaagattcgtctcaggttattactgttgatcttcaaggtttgtgattgtgacgcttatacatgtgctgaaactgtggtgtttatttattgaaaacaaaaaaaaagtctctcttgtagtttcattgtactaaatagaaaacaagaaacgtttttttctttaatcttctacattgataatattggatcaaaggattgtttctgcaagacacaacacaaacatacttatactagtttacttctactaagtactaactacatacccatacacacacttgcacctagactttacttctagacatcattaccctaaggtagaaccaagcttacaagcaagttttaccgacaactcttacattacaactctagtctgtagtctttaacgtagacttactaactagtcattagtggtttaattttttaaattttcatccatatgtttttgttgtagatataaactaaagtcggtcacatttaataattgtcattatgtccgcgtaaaagtcaattcagctattggacatttatgaaatgtaagattttctctctcatttccccgtgcgtgaagacatgcattggtttttctgtaataatcaacaaatccaaaccccttttcgatctttatttggacattgttagagacaaaatttctctatagtctttttcctaatttgataccatgtttttgtttctgcacaaatttactcactggtttaactaactatccacttatttatgattttaccattaggcgtcagctagccctagtcaaatttgtaaacaagccaagctatctacataaatcgagatgtcattaacgttaatcgtcgttaattcgaatttgaaaacatagatagctttagcagtacaatgggcaatggtaagaagaatagcaaaaggcccaatatttggtttgcagaaattaaagccttaaaaaaaagcccacagatatttgtcaaagaaccctaat

SEQ ID NO: 38 - DNA, 1024 bp, Arabidopsis thaliana
  misc_feature (1)..(1024): Ceres Promoter YP0092
aaagattgagttgagagagatggtggagacgcagaacagacaaagggagtttaccatatagtgctctaaagggcaatgagattgcagtgatgtggctatccggggaatcatcgcaggttattccttcccatgagcaacaatcaatggatgggttccaattcagaggagaaacagaagaagaaacgtttccagagaaccacagtagggattctcgatcttgcgagttgcagagagcctctgaaactgcaatagaaaggacactgatgaaaagaacacactgaaggagtatgccaatcatgtgaaaactcagagcttgtattggtcttgtggttgatgaagttctcacaaaacctttggctttgaatctcccctcattagtcatggtgagaacaagaacaagacgagaaacagacaaagaagatgaaaaaacttgttggccagtgttgactaagggggaatagccccagacataacaaaattagacttgtcgtacatctttaatatttttttatctgtttctttgtcctgacgctttcattattcctgtgatcaattttctcataccattggtccatcgttaatcctttcttaatttcattttctacgtaacatgagaggagaccaagtcctatgagaacagttgacgtaacagtggttgttaagttaagttaaaaagaggaagctagtgagagtgaccgttaggtagagaagtgagatctttaaccactcttctttctctctctctctgcttttttcgtcgtctttcacatctactgttcgcaaactctcttatgcttccaataatggtgataccaattgagacttgcaggagaatctcctcttctccacactctatcaactggtcagccatggaatggtcgtttcagtttcaatattcctggattctttttaaggattcctgtttctcttctgttcctggtatattcttaacgacgaaattagtatcggatcctggtaatacattttgaagcttttaagtaccattgcactgggatccaacaat

SEQ ID NO: 39 - DNA, 1020 bp, Arabidopsis thaliana
  misc_feature (1)..(1020): Ceres Promoter YP0096
gaggtcagtgagtcgattggtgcaaaattgaaaaattgaagggtgaaacaaatttaaagataatatctattaaatcctctaattttaaaaatttagcaaaaattgtattttcttatggatctgttagttcacacgtatcttaattagtaccaaatcatatctaatgattagtgataaaactagttagatatctatatgtgtctttaccatttaacttgaatccttcttcttttttttacgtaaacaacttgaatccttcgttaatacataaatttaaagcattttttctttaattctattgatcggtatatatttactataagttttagctcatatgcaatttcaaatgatatgcttttaaattttgtctaggtgtgatagttgtatctttaacataaatcttatagcaaaattatacttgatattctaaatttatctatttgctcttgtgaacctcatattagtctagagaaactttgaaatcctttcaattagttgtatgtccaatacatttttactaacatttattagtctttttaattaagattattgttagaaaaaaaaagattttttaaaaataaataatatgttttagatacaatgtgagttaggcttcttatattttaaaaaataaatttatttcatacttaaaaatagtttggaatttcaatttatttggctgaataccataaaatatgtcaatttgaaccttatacccattgactatttggtgttagaaaccctttaacaaaaaaaaactatttggtgttagatatcaaaataaaaaaagtttaaccattggtttcttatattgaattggatattgttacatgtattaaagtttttttggtttaattttgaaacgttgatagaaactattaagtttaagtttggtagtatatttatttgtggaaaatttaattgccattaaatataacgtcaactttttttggttttttttgagaagttacgttgtgattttgatttcctatataaaagttagattacgtcattttttaa

SEQ ID NO: 40 - DNA, 1000 bp, Arabidopsis thaliana
  misc_feature (1)..(1000): Ceres Promoter YP0097
ttcatctttatatttaagagtttaaaaactgcaacttttgtttttctttcactaagtcttatggccacagttaattaaaagcagatgaaaggtggtccaatggaaaaggagaatgtgattgggctagttgggagagttctgatgtctagtgttgggtacacgtgtccgtcagttacacatagcattaaatcagacggcatgtcattattcaaatctagttcacatagtacgactaatagctgataaattaatgattatacagcatatgaattatgaattcaaaaaaaaaaaaaaattgaaaatgttaaggagatgctatattttacaaaattcatcgcaatgctttctactaatttgctaagtggtcttctccagttagtcttgtcgattccaagcgatattattaaatcttgaagcatcgctcaaagcattatagcttaagataaccaaattgttattaaaaacacctagtgaaatttttaaattaaaacaattttgatatctttgtaatatctaatactactctttctgtgtctaaaaggattaattttcaaaaatttcacacatattaaaaaaaaaaaaaaattactagctaaacaattttcaataatcataaaacaatagtaacttaataatttttttttattttcaaaatagtccttcaagtttacaattcattttagtattataatcaacaaaatttgtattaaaaagttggaaaattaatctttgtggaacaaaaaaatctagaaatcattttttagaattagagagaggtttgataaaaaaaaataaaaaaaaatagagagaggtagtacatactaaacgatgtgatactactattgacaaaatcttaattctcagtttagtagaataaactagaaggaatgaatgaagtaaatgcgaatccaactactaacaaaccctacttagtcatcatattttcccatatgaaatccctatataaacccatcatcatctcccacttttttcatatcca

SEQ ID NO: 41 - DNA, 1004 bp, Arabidopsis thaliana
  misc_feature (1)..(1004): Ceres Promoter YP0101
ttctcgttctctagaatattgctggaccggattaggtcaatattattgggccagattagatattgaattgtcgacgttgcttacgttacgttatatcttgtttaagaattaaacctatcgacttagtcttaattaagaaaacattgccttaaattctctggtctgcgaccgtttttttgaccgttaacccctaattaaagaaacaaaataattatagaaagagcactgaaatgtgattattttaacagtactcttatgagaaaattcgtactttttagttttttttttgtacaaatctctaagaaaaacactactactaattaagaaacgtttcaaacaattttattttcgttggctcataatctttctttctcggtccgggactaaccgttggcaaaaaaaaaaaaaaagttgacaataattattaaagcgtaaatcatacctctcaaataaaaacttgaatttggaaacaaagacaactaaaaaactcgaatttaagagaattcctaaaatcaagtgaagtatcatcacttggtaaaatttcataaccgttggcttctatttctatgtgtgccttggtttgcaggagataatatttcatttccaaccaatgatattcgtacacatagtcaaacaaatgtttgtctttgttattatattgagaaagaaacaagaaagagagagagagatagataagacgaaggaagtgaagcttccaagcgcccaccgttaaaaatctcgtgtgcaagtttcaaatacaagtggccggtggtctccataatttgatcgtcatccaattaaaaaggaagaaaaagcgtgttttatacaagaaaactcattaaaatagcaagtctagaaatatctcaacactaatctaccacgtctattacacacacacacacacacacttgatcttaatttattttcaagattcaagaaaatacccattccattaccacaacttgaccacacgcctatatataaaacataaaagccctttcccc

SEQ ID NO: 42 - DNA, 1000 bp, Arabidopsis thaliana
  misc_feature (1)..(1000): Ceres Promoter YP0102
atttggttgataacgttttcactcgactaattatatacttcagaaggatagtaatagaataccaaaataattaaatgattggttagtgccttagtggagactttttaaccgattctaatagactaatgatgtagctaagcatttatttgggatcatcactgtttgaaaacgtgaaatgtgataaaagttatgaaacgattaaaatataaaataaccgtacaaaacattatgtaccgtttttttctctgttcttttggcgatttggtttagttcgttacactctaaatgttattgcagatatatatataatgatgcatttgcatctgaggaacatataattccggttaacacttccaaatcttatatccgtctaggtagggattttataaatcatttgtgtcatcatgcgttatgcttgtcggctttgaccataacgcagagatatagaactagcttttacttaacttttagatttattatttgatctagagttaagtggagatatatagtgtttttgttagattattggtggatgtgagagtttgtctttagtttcaagttgagaatataaggcaagaggagactctgaggcaatcagaggttttgattggcaaaatatccaaaaggcccaaaccaagtcgaagcccatctcgtacaaaaaaagaaagagatctgtaagaaaaaatattctttgatattcttacaaaaataagtgtaaaacttttattagtcaaaatcttcaatctttaaaaactctcatcactcctacgaaagcgcgtgagagttatgagacattccttaatagcattactcacaagtcacaagttcaaaacgtctgactgaaacagaaacaagcctttgttgaagtcttgaagaagagacattagtactcgtcgtatagccataaaaggtaatatacgaaatttcttcgctaatctcttcaccttcctctacgcgtttcactttcactttataaatccaaatctcccttcgaaaacat

SEQ ID NO: 43 - DNA, 1004 bp, Arabidopsis thaliana
  misc_feature (1)..(1004): Ceres Promoter YP0103
gttttgaagaacaatctggatcgaaatctaacataaggtcatcgtattcaagttacgcagtcaaggacttgacatcatcctactctggtctgaggttaccacttccaaagatgggatttttcgactcggtatgcttcctaagaaattcgttttattgaacctagcaaatatcttgtaatgtaagattcctgagatgatgaagaaaaaacaaacttttgttacagcaggagaacggagagaaagaaaacagagaaccaaatgctcttgaagcaaacagaagaagaagacacaaatccaaacttgagacttcttctacaccagaaaaccgcagcattctgggacaacgcaaaacacgaaagtgaaacgggcaatgatatatatgtcttgggtgcgttacaaggcatcgtttgcaactgttgagttggataagtcaactgtcttcttttcctttggttgtagtagctgccttttttttcctttgttgctttaagaaatagcccgaaaaaaagaatgttctacatttcggagcagaaaactaaccgaatgagtttttggtcggatcatcggatcgatcagatatattttgagttacgaactgttataaaaaaagccataattttgtgttgagtttgcaaaataccttataacttgttatttgagattgcacctccatatatattaattcgtaagagtatttattaagtaagctttagtataaatccttttttcctttaaagtaagttaatgttctactaaataatagtaaagttgaagaaccgctccgtttttacaccatgcacgtgttatctaacaaagaaaatatggtacacctaatggctaatgcaaaggacaacacaatgaaactaacttgactctgtgttatagaaacccatagacatctgcatacatcctagtatttgtataaattggactcaaattcctgaggacaatcatagcaaacaatcacatcatcgcaatatacataaacaaaagaggaagaaaaa

SEQ ID NO: 44 - DNA, 1003 bp, Arabidopsis thaliana
  misc_feature (1)..(1003): Ceres Promoter YP0107
taacaatccttgggaacattgcatccatagatatccggttaagatcgatctttgaactcataaaaactagtagattggttggttggtttccatgtaccagaaggcttaccctattagttgaaagttgaaactttgttccctactcaattcctagttgtgtaaatgtatgtatatgtaatgtgtataaaacgtagtacttaaatgactaggagtggttcttgagaccgatgagagatgggagcagaactaaagatgatgacataattaagaacgaatttgaaaggctcttaggtttgaatcctattcgagaatgtttttgtcaaagatagtggcgattttgaaccaaagaaaacatttaaaaaatcagtatccggttacgttcatgcaaatagaaagtggtctaggatctgattgtaattttagacttaaagagtctcttaagattcaatcctggctgtgtacaaaactacaaataatctattttagactatttgggccttaactaaacttccactccattatttactgaggttagagaatagacttgcgaataaacacattccccgagaaatactcatgatcccataattagtcggagggtatgccaatcagatctaagaacacacattccctcaaattttaatgcacatgtaatcatagtttagcacaattcaaaaataatgtagtattaaagacagaaatttgtagacttttttttggcgttaaaagaagactaagtttatacgtacattttattttaagtggaaaaccgaaattttccatcgaaatatatgaatttagtatatatatttctgcaatgtactattttgctattttggcaactttcagtggactactactttattacaatgtgtatggatgcatgagtttgagtatacacatgtctaaatgcatgctttgtaaaacgtaacggaccacaaaagaggatccatacaaatacatctcatagcttcctccattattttccgacacaaacagagca

SEQ ID NO: 45 - DNA, 1024 bp, Arabidopsis thaliana
  misc_feature (1)..(1024): Ceres Promoter YP0110
gggatgcggttccgcttcctcttgatcttggacgagtcggaggacattgttggatcccagtgcaatggtaatataaaacaagaaaacaagagattttataggacaatcactaaatgacatttaattgattaaacatttattcattaataattgtatgttactaacttcaacatttaataattttgtttaagatacgtttacatcagagactattaatatttttacaggttgtaactttaaactttgtcttgaatcgaacatgactatagattttgggcaaacttaaagataacaacatttccgttttttttcaaattattacaaatcaaactgatatattagacacaacacgattacacgtaatgaaaaaagaaaaagataaaaagataaaagaagggatcgattctgtttggtctggtttagtgagattcaaagttaagctcttcctttcaagacatgccttcttaaaccgggaatgtgaacgtttgtaatgtagtccgtccagttaatgcttccaacatcaaatccaaattctctcttctcgtcctctgacatattctccattaatctctggggtattgctgttatcaaatctgtaaaagaaaccaaaaaaaaaagatgaaaactttgcgggtaccggttttgtctgctctaagaattagaatgttaatgagttctgtcttaccttccaccatagaaagtgtatggctcataaatagtagcaaggtgtttggcttgttcaacagatttcttgcatataaactttagcttctgcatcatcttactatccactgaactcataccactcatcaacccactccgttcttgagcatctctccacaaatgatccgagaaatcatcaacggaattgaaaagtttcatcaaacgcaccataataggatcacctttagagtccatgcatggagatgttttgtagtggttataaagaagctccgctaagtcttcgaaaaccagcgggtttatcgccgaagaagcgatctgatacacgtttatttcaggttcc

SEQ ID NO: 46 - DNA, 1024 bp, Arabidopsis thaliana
  misc_feature (1)..(1024): Ceres Promoter YP0111
cgattggatttagtctatacattatagggcgcaagtttgtggatttaagaattatataaaaacttgaaatatatagtttttatgcattctcctcttgtgtaatacataaaccaaatatgagataggttaatctgtatttcagataatattaaattccaaacaatatttttacttgttataagaaggcaattaatatctctctgttaatggcaagtggtaccaagtagtattaaactattaatgcaatggaagagtactgttggaaattataatcctctatcacacattcaaacagatctcctgaaatcttctcttccaaacttgtacttctctgatccaaatgtaggctccaaaatatagacatttaccatttactaagtccacaactcctttcttgtctccttcaaaaatgactcttgtgtaaccaccatatgactccgacagttcggcattgccatgatgagagcttaaaaattcaccttcctgagcatttcaagtcttcactcccttagcttgacctgaaccaagataaaatgcctttgtcgtcccgtaatatccatcctgctttggacggcatcatagttacattcgatccatcctatttacaatgttattttagtattaaaaacatgacaataaatttgttgttaaacatattcaaatacaatatgattggatttataagtaattgtaatatgaaatgtccttagtaatatgttaaaaaatacatagatacacacacgtactaaaagaggcaacgcgggagatgtcattagaggaagaactaggaagcagagcgttcatgcaaaatgctaccaaaaacgttaatgcaatatctcaactaatcagcacagtccatttcatactgagaatgtaaaaaccaatcagcatcgtccattttttcatctaattatttgttaactcttaattggccacaacttccaaccacatgacgctctttctattccctttatatattcccatctcaaatgttcttggagacacaaaatatcataaacatata

SEQ ID NO: 47 - DNA, 996 bp, Arabidopsis thaliana
  misc_feature (1)..(996): Ceres Promoter YP0115
gtcgattggatgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttac

SEQ ID NO: 48 - DNA, 1024 bp, Arabidopsis thaliana
  misc_feature (1)..(1024): Ceres Promoter YP0117
gtcagtgagtcgattggatcacagtcctttatgataaaacaaactcataattattccaccgacaacatgcgttttaaattattttttcttaaattatattatattatattgatatcaacctagctaaaataattcggatggcgaaatcggacaatttttaatagaaaaaatgggtatgaagatagtctatgattccgttcttagcgactagagggacctgctcaaatctcccgggtgatacgcgatgtcaagctcaatagaaccccacaaccgacgagaccgagaaatccttgatttgggctagaagattttgaaataaatttaatatattctaagtaacttgcttaaattttttttcaaactctaaagacataactaacataaagtaaaaaaaaaaaagttaatacatgggaagaaaaaaattaaactaatgattagctctctaacgtgtttaatctcgtatcaagtttttttttaaaaattatattgctattaaaacattgtactattgtttctattttgtttagctattattcttgtgaaatgaaaagttgtgtttattcaattactaaatggcaatatttatcttggaaaactatacctctaattggattaggccctagacatcctctttagcttattgacgttaaaattattcccaaaactattaaagtttagtagtttgaaagatgcatcaagacctactcagataggtaaaagtagaaaactacagttagtgtgattatattttaaaatatataaaacaatcttattaaactaaatattcaagatatatactcaaatggaagataaaaacatttagtctgttaccactaccagcctagctagtcactaatagtcactttggaactgagtagatatttgcatcttgagttaccatggactcaaaagtccaaaaagagaccccgagtgaaaatgctaccaacttaataacaaagaagcatttacagcggtcaaaaagtatctataaatgtttacacaacagtagtcataagcaccattg

SEQ ID NO: 49 - DNA, 1000 bp, Arabidopsis thaliana
  misc_feature (1)..(1000): Ceres Promoter YP0119
taccaaaaataaggagtttccaaaagatggttctgatgagaaacagagcccatccctctccttttccccttcccatgaaagaaatcggatggtcctccttcaatgtcctccacctactcttctcttctttctttttttctttcttattattaaccatttaattaatttccccttcaatttcagtttctagttctgtaaaaagaaaatacacatctcacttatagatatccatatctatttatatgcatgtatagagaataaaaaagtgtgagtttctaggtatgttgagtatgtgctgtttggacaattgttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggtaaggttgtgaatattatgcaccattcattaaccctaaaaataagagatttaaaataaatgtttcttctttctctgattcttgtgtaaccaattcatgggtttgatatgtttcttggttattgcttatcaacaaagagatttgatcattataaagtagattaataactcttaaacacacaaagtttctttattttttagttacatccctaattctagaccagaacatggatttgatctatttcttggttatgtattcttgatcaggaaaagggatttgatcatcaagattagccttctctctctctctctagatatctttcttgaatttagaaatctttatttaattatttggtgatgtcatatataggatcaa

SEQ ID NO: 50 - DNA, 999 bp, Arabidopsis thaliana
  misc_feature (1)..(999): Ceres Promoter YP0120
tagtttttgatttaatctacgtttttcttaatcataaatgggtaattattagtttttgcaaaatcaaaatccaaaaattgttctaaacactgcaaccatttaaggcctatatcactcagaaaatttctggtgggagaactaatcgtttgtcctttctaaatctcacatattagaatttagaattagtgtgctacataagaatattagttcagctcggaacaactattttttggtaaaacagagaacttaaacaaatgcattattttatcaacatgcattttgaattgaatataaaatttcataattgtaaagacataaattacataaaattttacatgaaaaaatagatatagaaagaaaatgaaactaactgatgatatgctctctaaattttttaatctcataacaagaattcaaattaattagttcatatttttggttaatataacatttacctgtctaagttggaactttcatttttttctgttttgtttagtcagtattcttaatgtgaaacggaaagttgaatttattcaaacttaaattcaatagcattaattaaaggcgaaagctattatctctacatgtggttcaaactagacatccaatttaattagcttattgacgttgaaatgttttccaaaactactatagtttggcaatttgaaagatgcatcagaactactcagacaggtaaaagtagaacctctagctgtgtgaattgtatgttagtccataaagaacatcttgtaaacttcatacttaagatatatattacaatatatacttgaatggtagataaaaacgattagtctgattgctagcatactcacaactatttggaaatgagtaagatattggcattctagagttactactatggagacaaaagtcgaataaaagagacctcacgtgaaaatgttacgagctagtaaaaaaagcatttacactaacggtaaaaaaagtatctataaatgtttacacaaggtagtagtcatt

SEQ ID NO: 51 - DNA, 999 bp, Arabidopsis thaliana
  misc_feature (1)..(999): Ceres Promoter YP0121
ttggattttttttttgttgagtcagcagaccatctaatctctctttttccaccacagcctgctttctatgaagcatttgggcttacggttgtggaatcaatgacttgtgcactcccaacgtttgctacctgtcatggtggacccgcagagattatcgaaaacggagtttctgggttccacattgacccatatcatccagaccaggttgcagctaccttggtcagcttctttgagacctgtaacaccaatccaaatcattgggttaaaatctctgaaggagggctcaagcgaatctatgaaaggttggcccattctccttgacaggcttaacaatacaacttgtatcgcttcaacaagatgatggcttaataaggatttttgcatgtataggtacacatggaagaagtactcagagagactgcttaccctggctggagtctatgcattctggaaacatgtgtctaagctcgaaaggagagaaacacgacgttacctagagatgttttactcattgaaatttcgtgatttggttagtgtaacccactgttattcttttgatgtctacatctactttacttacattattcttttcttcggtttgcaggccaattcaatcccgctggcaacagatgagaactgatcatgacagggtaggattttatttcctgcactttctttagatcttttgtttgtgttatcttgaataaaaattgttgggttttgtttccttcagtggtttgattttggacttatttgtgttaatgttgttttggctgttctcttaatatcaataacaaataaatttactggttggtatctaagatctaacaatagttactatttttagaggtaaagacaccaaccttgttatattggtcagagagctaaaaccttgacttgttgggaaaacaaaactctaatgacagaaaatctgacatgatgccttataattcacagcctcatgttctacataaatcctaacaatagcactttgtttct

SEQ ID NO: 52 - DNA, 1004 bp, Arabidopsis thaliana
  misc_feature (1)..(1004): Ceres Promoter YP0128
gataaactgataatggaaaagaacaaagaaaccagtttttaactatttgcatatgtaatttatttgttgcaaattatatttagttaaaatgtttcctctatttatatatatatatatcagtcaagcactatgtataagaaatgtcaatttataaatttttacatgtcctttaacagaaagaaaatgaatttttacatgtcattcatagagagtcactcgtttatttcttatatagagaataacacactcacatgcatatgcatgcaatatgatacattttatgacaaagataatcaacggaaacggtcaagacataatttgataaacaacttgcacgatgcacagatctgatcaaatatataactctttaacatatccaaaatattcaaaaagaaaaactcgatccaaactagcaacatcacgctcacgcggtaggctaaaaatttattaatctccaaaagtctttcttatgaacactgcaaacacaacaacttgaaaagtcatataggtttagatgatgacgcgtattggctatcgcttaccggagtggctcataaatacaataaacaatacgtaaaagtcaaagtcaaatatatttagtcaactataaccattaatcgggcaaaacctttagctgtcaaaacaacgtgaaaacgatatttgtatatatcatcaagaatcagtagataagagaatgatttaatcccctgactattacaattttggtgtaataaacagtctctattggtttttattctttgttttaatttctcatgacctatagagagaattaggtagtttcgaaaattggctaatcaacttttgaaaactactgtctactttgcttaaattctctacacttagtttcggataagataattgtcggactaatagttaatcccttgacaatctttgatattataaaaggtttagttaatctcttctctatataaatattcatacaccagctttcaaaaatatataatccaaacaccaaaaacaaa

SEQ ID NO: 53 - DNA, 1001 bp, Arabidopsis thaliana
  misc_feature (1)..(1001): Ceres Promoter YP0137
gtggcacatgctgaaaccccgagcatctctccggaagacacgcgtcgttcgctccaaagaaaacagtcacagctgccggagaatctccgccgtcttcttctgccaccggaaaaactctctccaccactttcagtgcccacctcgtgttatatccactgtatcctcgtagcaccatatcagcctaataaaattttatgtatcaaattttaagacatagccgaaactacactatactagacaataataatatgatttgtttcctgaaaaattatggtttcatgagaaacattaatcatctataaaacaaattagctatggcatcgaagagttatcaatcaaaactgatgaatctttacttaatatatacaacatatctttaccttgcggcggagaagatcggcgagagaagcaccccagccaccgtcactaaaggattcttcagtgatggaatcaccaaagagaaaaaccttccgtctcatcatcttccacacaatcttcttgagaaaatctgagagataagaaaggtgtagtggttttgctgaagtgatcgtgtttgatttagtaaagaaatgctttatttattgttgggggaaacataaataaataaagtaaaagtggatgcactaaatgctttcacccactaatcaccgacctttcatggtttattgtgaaatacactcatagatagacatacaataccttatgtacgtaaataacattttatttgtcgacacttatgtaagtaacgcatagattattttctatgtgattgccactctcagactctcagtttcaaccaataataacaataactacaacaacattaatcataaacatatgctctggtttacaattaaagcttagattaagaaactgtaacaacgttacagaaaaaaaatgttatttacgttttgtaagattagtctctagaatcatcaccgttttttatatattaatgattctttcttatatataaaacctttctcgaaatacccatgaaa

SEQ ID NO: 54 - DNA, 1001 bp, Arabidopsis thaliana
  misc_feature (1)..(1001): Ceres Promoter YP0143
atacaacagatggcagatatcgagttaaatacgtgaatcagccgttacgatattttaaaactagaaaattatttaaaaatattgcaaaataccatttaatttcattgttcataaaaaaaagaaattcaaaaacttaaaaactgattcaaaaatttggattaattctcattaacagtcttcaacactacaacaacatgtttctaatttattttatattttaataattaaacaatatatacgtctgcacattgttgctccgacataatctagtataaaaatagttgcagcatatgtgaaaagcaagcagcatttatcactcaatacttttaattttatctgttgtatgtattaaggttttgtagctttaagaaaacgcttataatataaaataacttctaaaagatatttcatgcgtatacaataaatatttgtgaaaaaacatttcgaaaacgtgtacaatatataaactattgtgttatcttttgacattcaaacaaatgttgacaatgtaattttatccatgatatgattggccaattagctgcgaggtaaaaatccgtatacgagtaaaagtaagataaaatttcgcaagaagatttttagcaggaaatctaagacaagtgtcatgaacgtgtcaatcaacaaacgaaaaggagaattatagaatccagattcgacgtaccacattaataaatatcaaaacattttatgttattttatttttgctctggcagttacactctttttcattgctccaataaaaaaatcactcgcatgcatgcatatatatacaccatagtaaactccgcctcttcttcattttaaaagtatcagtttacactgacacaatccttaactattttcctttgttcttcttcatctttattacacatttttttcaaggtaacaaataatctttttaagtcacttttatactctttaaatcttagattgatatatgaatgcatgttaatatttcaagatttataggtctaccaaac

SEQ ID NO: 55 - DNA, 1003 bp, Arabidopsis thaliana
  misc_feature (1)..(1003): Ceres Promoter YP0144
aaacgttgcaagattattgattgtgagaaagagtgctcaaggtagtactgatttctgtaaagctcacggtggtgggaaacgatgttcttggggagatgggaaatgtgagaaaatttgctagaggaaagaagcggtttatgcgctgcgcataacactattatgtctcgggagaacaaagatggaagcaagagcggtttgattggaccgggactctttagtggccttgtttttggctctacttctgatcattctcagtctggagctagcgctgtctctgattgtactgattctgttgaacgaatacagtttgagaataggcagaagaacaagaagatgatgataccgatgcaggttctagtaccttcatcaatgaaatctccaagtaattcacatgaaggagaaacaaacatctatgacttcatggttccggaggagagagttcacggcggtgggctagtaatgtctttacttggtggctccattgatcgaaactgaaagccatttatggtaaaagtgtcacattctcagcaaaaacctgtgtaaagctgtaaaatgtgtgggaatctccgaatctgtttgtagccggttacgttatgctggatcaaaaactcaagatttgttggatattgttatgctggatcggtggtgaaaccacttcccggttgctaaataaataaacgtttttgttttataatctttttcactaaacggcagtatgggcctttagtgggcttcctttaagcgaccaatacaatcgtcgcaccggaatctactaccatttataggtttattcatgtaaaacctcggaaaatttgagagccacaacggtcaagagacaaaaacaacttgaagataaagggataaggaaggcttcctacatgatggacaacatttctttccacacaaattctcataataaaaatcttataatacaaatacttacgtcataatcattcaatctagtccccatgttttaaggtcctgtttcttgtctgatacaaat

SEQ ID NO: 56 - DNA, 1004 bp, Arabidopsis thaliana
  misc_feature (1)..(1004): Ceres Promoter YP0156
ttggtttgcattgtgaagatttgtattaactatagaacattgaattgatggtgttaagttcttacacaagcgtgcttctcggtttgaactgtttcttttgtatgttgaatcagagcttagtttataggaaccagagtatctacttagtcattctctgatgctaagtgctaaggttctacctagttgccctctaggcccttatgttattgataacttatgaagctatttgaacacttgattcttaggagacctaagttggtacagccagatagagtgtatgttcttgttctctatgtgacaggatcaagctgccacacatagttcaagggtatgctctgtgtgggtttgctcagattgaggacaaatctatacaaggaagtagagtctttgacattttgatgttgtatgataagaagaagaaaggagagtaataaagaaagagaaaagggaaacagaaacacgtgggagaacatcccaaagaggaagcacacgcggatcttcatgcaaagctccccgattctcccatgtggtccctttctccctttgtccccctcctctttcttcttttctcattttactcctttttttaccattatacaacgaatcttttttatcataattttttggttttggtttattttccaataacactttcttggttacttcccattctcactttttcatataagaaactcactttgggaaacttatgtttgagaatgacaagtctttttagagaaagtgatgtaacaaatctaaagtgattatataataaccttgcacaatgtttttgattttttgtaagattcgaatattaggtttattattcgtagggaataaacttactttcaaaagcgttcataagttaatactttcatatatgatcataagtacggacactattgttttttgtttgtttgtgtttattctaaaagaaagtagcttttaattgaaatgtcctcggaggcacagtttaaagttcgagtgtaacagtttctaaggca

SEQ ID NO: 57 - DNA, 1000 bp, Arabidopsis thaliana
  misc_feature (1)..(1000): Ceres Promoter YP0158
ttattagattaatagattgcattgcattgcttgtgctttcaatttacaaattgtctcccaactccatcgacacatctctttttgtgtatataagattcagacttgttatattttttttataaatatgttattagcatcttaagttaaattgattttttatatctgcattaaggattacacgactatatttgcgattgtgtgttggttaaaatataatttaggattgtctttaactacatttaggattatatgactatatttggttaaatataaaatctagctgtgattattagtattcaaaaataagtagcctaaccaattaaaacaacggctattggggcaaattagaacattttagtgtgtccaaaatataatggtcattaggtcatattcctcctagcttcatcgcagcataattgaatgattgccttatttagaagagcttttccactttcccaaaatctaggtgggatctttttgttttgaccttcatttttcttgtttaccatttttagctaaattatttacgattacaaaagatatcaaaagttggatcataatacaatttatagacttactgtagaaaattcgtatgtacaagtacaacaaattcttcataataaattttgaaaattctattacaaatgttgtaagaaatagaatttgaaatatatataaactaaggagaaaaaaaaagagaacatgcattgctctagtcagagtggaccaacatcaacgagataagataacataaaaaccaactcaccataactaaaaacatcccaagagatccaacgattcatatcaaacacaaaaacatcgaacgatcagatttaaaccatctctggtatctccaaaacacaaacacttttttttttcttttgtctgaatggaacaaaagcatgcgacatctctgtgtctttatcttctctctcctcttcttgaaaaactgaacctttaattctttcttcacatctcctttagctttctgaagctgcta

SEQ ID NO: 58 - DNA, 1005 bp, Arabidopsis thaliana
  misc_feature (1)..(1005): Ceres Promoter YP0188
gattggtatgaaatttcggagaccaacaaaaaaaactttattgagcttggagtgaagctatatatatggggcaagatcataatatgtttatatcggccttttcgttaactgaaaataatagttttgagaaatatatcaaatggtaaacagacatcatctttgaaaaataccatcaatgaagttaatattgttattggcatatggtttacccatcttaattttaatgcaaccaaacaaacaagaaacaaaaactgtataagatacaaggtgttttacgattttccgtcttaaaaccgaaatatttttgttcctacgactttaaacggactttgcttaagttgtgtgcatgtaagctcgtcgtccctcgattgtcatcaacattcaccaatatcagcctctatcacacgagtgaaggtggtgattcggcttaatgaaaacagagaaatatttcaatatgattcctattaaattttaaatcttttttctcaatctctagattttcattaaaagcatcatgatttttttccactatgttcatatatctctatcacagttttaggtacattgtagaaattggataagatacgtcatacgtctaacatgaatttggtctagcaaggaaggtttgagataataagtgaaaagaaaacacaagataataaattataatttataaatgctttatagtattgaaaaataagatgattttttttttttttaataccggattggctgatccacttatgatgactcaaatgttattaagtttcaagacaatttatgatgacacaaatcacaatgagtcaatagtagccacgaagccagaaaaaaaaaatgtactacaaaaagataatgatagtacaaaatgatacgtcgtactgccacatgtacgacacaactcgattaccaaaaagcagagccatccaaccataaaactcaaaacacacagattccactggcgtgtgctctcctcacttcactcgtccttgaaacttgaggtactga

SEQ ID NO: 59 - DNA, 1002 bp, Arabidopsis thaliana
  misc_feature (1)..(1002): Ceres Promoter YP0190
taaatagtgacattggtaagaagaaaaaaaacactattaaatagtgaaaaaatggtttataactctcttaattaacattacttattattgctagcacctaaaatctcccacaaaatatttgttgtaaaacacaaatttacaaaatgattttgtttttaaattagtaacacatgttcatatatacgttaataagaacataccctatatgattttatataaaaaaatttctttgagacgtcttattcttttttctttaataatatgcaattgtgagagtttggatttgaatggtagcattagaagcaaacttgaaccaaacatatttcatgaagtcaaacttgaaccaatgtgatcactaatcacagtgttcgcagtgtaaggcatcagaaaatagaagaagggacatagctatgaatcatataatcttgacacatgttttataggttttaggtgtgtatgctaacaaaaaatgagacagctttcttctaatagacttaatatttgggctaaatgtaccacagttgtgaatttcttacaaaaatgggccgagctacaaaaaactacaggcccactctcaactcttatcaaacgacagcgttttacttttttaaaagcacacactttttgtttggtgtcggtgacggtgagtttcgtccgctcttcctttaaattgaagcaacggttttgatccgatcaaatccaacggtgctgattacacaaagcccgagacgaaaacgttgactattaagttaggttttaatctcagccgttaatctacaaatcaacggttccctgtaaaacgaatcttccttccttcttcacttccgcgtcttctctctcaatcacctcaaaaaaatcgatttcatcaaaatattcacccgcccgaatttgactctccgatcatcgtctccgaatctagatcgacgagatcaaaaccctagaaatctaaatcggaatgagaaattgattttgatacgaattagggatctgtgtgttgaggac

SEQ ID NO: 60 - DNA, 995 bp, Arabidopsis thaliana
  misc_feature (1)..(995): Ceres Promoter YP0212
agtcgattggtacactcttaatttaattagagtaagagatcaacaaaaatatagaattttctttatatcgaagtgctacgaccttatatatatagaaaaaaaagcataggtgaatctctaaattgagattgtgctgtagtaaacatattaagtttttagtttttttaagaaatgaatctttttgttgattaattcaaactagtagtcattaagattccggagattccaatttagaaaagtcaaagattcaaagaacaagtccaggtccacatgttgaatccgattcatcatccactcatccttcatatcttcctccaccgtctccgcccaaaaaatcaataacaataaaaaatcctaaaaaaacatatttgattttgaaaaaactttatcatatattatattaattaaatagttatccgatgactcatcctatggtcagggccttgctgtctctgacgtccttaattatcattatttttaaatttgtctctctcagaaaattacgccacaatcttcctctttcccttttccgaaaacagctaatatttgtggacctaaactaaataacgtagcctctagattttatataattactaatactatatgctactacttgttattatttactccaatcatatatgataccaatcaagaatcactacataagtagaaaactttgcaatgagtccattaattaaaattaagaataaacttaaaattttatggtattttaagattccctttggattgtaatgacaagaaatcagcaaattagtcgtaactcgtaagaataaacaagatcaatttttactttctttacaaagattccgttgtaattttagaaatttttttttgtcactgtttttttatagattaatttatctgcatcaatccgattaagaagtgtacacatgggcatctatatatatctaacaggtaaaacgtgtatgtacatgcataaggttttacgtgcttctataaatatatgtggcagt

SEQ ID NO: 61 - DNA, 1024 bp, Arabidopsis thaliana
  misc_feature (1)..(1024): Ceres Promoter YP0214
ccagtcgattggcgcctcgcatgcctatcatatttaaccgtcaataatggatttggcggttttggtaggccgggtcaaccggattaaaagaaaacggtttggagtccttccttgcaattgaattttcacacattcgggttttgtgatttctctgtcataatgggcccggcacatatggttcataacccatgtgggcctatggtataatttttccaattaaaactattgttaggtcgataaaacaaaaaacaataaaaacgagtggaatacacataccaaaaagaatgtgatgaacattagtaattttattttgatggttaatgaaaaacaaaataaatgcatcttggcatcttccgttggaaagcgcaaatagggcagattttcagacagatatcactatgatggggggtgagagaaagaaaacgaggcgtacctaatgtaacactacttaattagtcgttagttataggactttttttttgtttgggcctagttataggatcataaggtaaaaatgaagaatgaatattagattagtaggagctaatgatggagttaagtatgcacgtgtaagaactgggaagtgaaacctcctgtatggtgaagaaactatacaacaaagccctttgttggtgtatacgtattaatttttattcttttatcacaagcgatacgtatcttaagacataataaatatatatcttactcataataaatatcttaagatatatatacagtatacacctgtatatatataataaataggcatatagtagaaattaatatgagttgttgttgttgcaaatatataaatcaatcaaaagatttaaaacccaccattcaatcttggtaagtaacgaaaaaaaagggaagcaagaagaaccacagaaaagggggctaacaactagacacgtagatcttcatctgcccgtccatctaacctaccacactctcatcttctttttcccgtgtcagtttgttatataagctctcactctccggtatatttccccattgcactgga

SEQ ID NO: 62 - DNA, 911 bp, Arabidopsis thaliana
  misc_feature (1)..(911): Ceres Promoter YP0263
atctagctgtggattccaccaaaattctggcagggccatgatctaaaaactgagactgcgcgtgttgttttgcagtgatttgtatttcatatttgcaccatcctacacagtccacttggtatcgtaaccaaacataaggagaacctaattacattattgttttaatttcgtcaaactggtttttaccttttagttacatagttgattcttcatttgttttagtagttatggagcacaataatgtgcaacaaagaaagatcatagtggattaatatgttgagaggtcagaaattcttggttaacaaaaaaaagttacaaggactgagattttgggtgggagaaagccatagcttttaaaacatgattgaacttaaaagtgatgttatggtttgaggggaaaaaggttgatgtcaactaagatagttgaagtaatgtcttaaactaaagtaaaccaccggtccaaccgtggtccggaagcatctctggtatgatttatcctaaaaatcaaaatagtagaaacatactttaaatatatacattgatcggacgaaaattgtaaactagtatagtttcaaaaactagttgaacaggttatgtaccttaaacatttatttcaaacttaaacactaaagaacatatatgaatagaagtttatataaattactatatatctaccataaatctcttataattatgatgtcacgatgaggaagtgttgaaacgttaaaatgccaaaatataagcatgcgacggaattttggcagaagattgtagagttgtaatctgtcgcaatcattactcgtgctagcatttttcattttcccttcatttgtggataacgcacgatataacattctacacaccaacaagattctataaaaacgcaaaggttgtctccatagaatatcgtc

SEQ ID NO: 63 - DNA, 999 bp, Arabidopsis thaliana
  misc_feature (1)..(999): Ceres Promoter YP0275
aaacattaatatgtagtaactatgggcgtatgctttactttttaaaatgggcctatgctataattgaatgacaaggattaaacaactaataaaattgtagatgggttaagatgacttatttttttacttaccaatttataaatgggcttcgatgtactgaaatatatcgcgcctattaacgaggccattcaacgaatgttttaagggccctatttcgacattttaaagaacacctaggtcatcattccagaaatggatattataggatttagataatttcccacgtttggtttatttatctattttttgacgttgaccaacataatcgtgcccaaccgtttcacgcaacgaatttatatacgaaatatatatatttttcaaattaagataccacaatcaaaacagctgttgattaacaaagagattttttttttttggttttgagttacaataacgttagaggataaggtttcttgcaacgattaggaaatcgtataaaataaaatatgttataattaagtgttttattttataatgagtattaatataaataaaacctgcaaaaggatagggatattgaataataaagagaaacgaaagagcaattttacttctttataattgaaattatgtgaatgttatgtttacaatgaatgattcatcgttctatatattgaagtaaagaatgagtttattgtgcttgcataatgacgttaacttcacatatacacttattacataacatttatcacatgtgcgtctttttttttttttactttgtaaaatttcctcacttttaagacttttataacaattactagtaaaataaagttgcttggggctacaccctttctccctccaacaactctatttatagataacattatatcaaaatcaaaacatagtccctttcttctataaaggttttttcacaaccaaatttccattataaatcaaaaaataaaaacttaattagtttttacagaagaaaagaaaaca

SEQ ID NO: 64 - DNA, 981 bp, Arabidopsis thaliana
  misc_feature (1)..(981): Ceres Promoter YP0285
gggattatatatgatagacgattgtatttgcgggacattgagatgtttccgaaaatagtcatcaaatatcaaaccagaatttgatgtgaaaacactaattaaaacatataattgacaactagactatatcatttgttaagttgagcgttgaaagaaaatgaaagagtgtagactgtagtacgtatgagtttcccaaaagatggtgcttgaatattattgggaagagactttggttggttcggttgaatgaagatttttacctgccatgttgatagagaaaggcaaataaatgtaggggtcgatgtctaacgtaaagactggatcaaccaagagtcctcctcctcgtcttcaccaaaaaaaaagagtcctcctcgtggaaacttatttcttctccagccaagatctcatctcatctcttcactctatgaaatataaaggaatcttatggtttttctaaaaactatagtacgtctatataccaaaggaaacaatataaaatcagttaatctgataaattttgagtaaataataaagttaactttgtacttacctatatcaaactaattcacaaaataaagtaataataacaaagaatttttagtagatccacaatatacacacacactatgagaaatcataatagagaattttaatgattttgtctaactcatagcaacaagtcgctttggccgagtggttaaggcgtgtgcctgctaagtacatgggctctgcccgcgagagttcgaatctctcaggcgacgtttcttttgttttcggccataaaggaaaaagcccaattaacacgtctcgcttataagcccataaagcaaacaatgggctgtctctgtctcactcacacacgcgttttcctactttttgactatttttataaccggcgggtctgacttaattagggttttctttaataatcagacactctctcactcgtttcgtcaacattgaacacagacaaaaccgcgt

SEQ ID NO: 65 - DNA, 996 bp, Arabidopsis thaliana
  misc_feature (1)..(996): Ceres Promoter YP0286
gaaaacaatcataggttacgctattatcatcgaaaggtatgtgatgcatattcccattgaaccagatttccatatattttatttgtaaagtgataatgaatcacaagatgattcaatattaaaaatgggtaactcactttgacgtgtagtacgtggaagaatagttagctatcacgcatacatatatctatgaataagtgtgtatgacataagaaactaaaatatttacctaaagtccagttactcatactgatttcatgcatatatgtattatttatttatttttaataaagaagcgattggtgttttcatagaaatcatgatagattgataggtatttcagttccacaaatctagatctgtgtgctatacatgcatgtattaattttttccccttaaatcatttcagttgataatattgctctttgttccaactttagaaaaggtatgaaccaacctgacgattaacaagtaaacattaattaatctttatatgagataaaaccgaggatatatatgattgtgttgctgtctattgatgatgtgtcgatattatgcttgttgtaccaatgctcgagccgagcgtgatcgatgccttgacaaactatatatgtttcccgaattaattaagttttgtatcttaattagaataacatttttatacaatgtaatttctcaagcagacaagatatgtatcctatattaattactatatatgaattgccgggcacctaccaggatgtttcaaatacgagagcccattagtttccacgtaaatcacaatgacgcgacaaaatctagaatcgtgtcaaaactctatcaatacaataatatatatttcaagggcaatttcgacttctcctcaactcaatgattcaacgccatgaatctctatataaaggctacaacaccacaaaggatcatcagtcatcacaaccacattaactcttcaccactatctctcaatctctcgtttcatttcttgacgcgtgaaaa

SEQ ID NO: 66 - DNA, 1000 bp, Arabidopsis thaliana
  misc_feature (1)..(1000): Ceres Promoter YP0337
taatttttttatttttggaactaacacttattagtttaggtttccatcacctatttaattcgtaattcttatacatgcatataatagagatacatatatacaaatttatgatcatttttgcacaacatgtgatctcattcattagtatgcattatgcgaaaacctcgacgcgcaaaagacacgtaatagctaataatgttactcatttataatgattgaagcaagacgaaaacaacaacatatatatcaaattgtaaactagatatttcttaaaagtgaaaaaaaacaaagaaatataaaggacaattttgagtcagtctcttaatattaaaacatatatacataaataagcacaaacgtggttacctgtcttcatgcaatgtggactttagtttatctaatcaaaatcaaaataaaaggtgtaatagttctcgtcatttttcaaattttaaaaatcagaaccaagtgatttttgtttgagtattgatccattgtttaaacaatttaacacagtatatacgtctcttgagatgttgacatgatgataaaatacgagatcgtctcttggttttcgaattttgaactttaatagttttcttttttagggaaactttaatagttgtttatcataagattagtcacctaatggttacgttgcagtaccgaaccaattttttacccttttttctaaatgtggtcgtggcataatttccaaaagagatccaaaacccggtttgctcaactgataagccggtcggttctggtttgaaaaacaagaaataatctgaaagtgtgaaacagcaacgtgtctcggtgtttcatgagccacctgccacctcattcacgtcggtcattttgtcgtttcacggttcacgctctagacacgtgctctgtccccaccatgactttcgctgccgactcgcttcgctttgcaaactcaaacatgtgtgtatatgtaagtttcatcctaataagcatctcttaccacattaattaaaaa

SEQ ID NO: 67 - DNA, 1000 bp, Arabidopsis thaliana
  misc_feature (1)..(1000): Ceres Promoter YP0356
ttagttcattgaaacgtcaactttttacttgcaaccactttgtaggaccattaactgcaaaataagaattctctaagcttcacaaggggttcgtttggtgctataaaaacattgttttaagaactggtttactggttctataaatctataaatccaaatatgaagtatggcaataataataacatgttagcacaaaaaatactcattaaattcctacccaaaaaaaatctttatatgaaactaaaacttatatacacaataatagtgatacaaagtaggtcttgatattcaactattcgggattttctggtttcgagtaattcgtataaaaggtttaagatctattatgttcactgaaatcttaactttgttttgtttccagttttaactagtagaaattgaaatttttaaaaattgttacttacaataaaatttgaatcaatatccttaatcaaaggatcttaagactagcacaattaaaacatataacgtagaatatctgaaataactcgaaaatatctgaactaagttagtagttttaaaatataatcccggtttggaccgggcagtatgtacttcaatacttgtgggttttgacgattttggatcggattgggcgggccagccagattgatctattacaaatttcacctgtcaacgctaactccgaacttaatcaaagattttgagctaaggaaaactaatcagtgatcacccaaagaaaacattcgtgaataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatcatccatactcatcataacttcaacct

SEQ ID NO: 68 - DNA, 1000 bp, Arabidopsis thaliana
  misc_feature (1)..(1000): Ceres Promoter YP0374
aagacacccgtaaatgttgtcatgtagaagaaactagaaacgttaaacgcatcaaatcaagaaattaaattgaaggtaatttttaacgccgcctttcaaatattcttcctaggagaggctacaagacgcgtatttctttcgaattctccaaaccattaccattttgatatataataccgacatgccgttgataaagtttgtatgcaaatcgttcattgggtatgagcaaatgccatccattggttcttgtaattaaatggtccaaaaatagtttgttcccactactagttactaatttgtatcactctgcaaaataatcatgatataaacgtatgtgctatttctaattaaaactcaaaagtaatcaatgtacaatgcagagatgaccataaaagaacattaaaacactacttccactaaatctatggggtgccttggcaaggcaattgaataaggagaatgcatcaagatgatatagaaaatgctattcagtttataacattaatgttttggcggaaaattttctatatattagacctttctgtaaaaaaaaaaaaatgatgtagaaaatgctattatgtttcaaaaatttcgcactagtataatacggaacattgtagtttacactgctcattaccatgaaaaccaaggcagtatataccaacattaataaactaaatcgcgatttctagcacccccattaattaattttactattatacattctctttgcttctcgaaataataaacttctctatatcattctacataataaataagaaagaaatcgacaagatctaaatttagatctattcagctttttcgcctgagaagccaaaattgtgaatagaagaaagcagtcgtcatcttcccacgtttggacgaaataaaacataacaataataaaataataaatcaaatatataaatccctaatttgtctttattactccacaattttctatgtgtatatatatacccacctctctcttgtgtatttg

SEQ ID NO: 69 - DNA, 998 bp, Arabidopsis thaliana
  misc_feature (1)..(998): Ceres Promoter YP0377
tataaaccattcctataacaccatatttaaacataacaatgaattgcttggatttcaaactttattaaatttggattttaaattttaatttgattgaattatacccccttaattggataaattcaaatatgtcaactttttttttgtaagatttttttatggaaaaaaaaattgattattcactaaaaagatgacaggttacttataatttaatatatgtaaaccctaaaaagaagaaaatagtttctgttttcactttaggtcttattatctaaacttctttaagaaaatcgcaataaattggtttgagttctaactttaaacacattaatatttgtgtgctatttaaaaaataatttacaaaaaaaaaaacaaattgacagaaaatatcaggttttgtaataagatatttcctgataaatatttagggaatataacatatcaaaagattcaaattctgaaaatcaagaatggtagacatgtgaaagttgtcatcaatatggtccacttttctttgctctataacccaaaattgaccctgacagtcaacttgtacacgcggccaaacctttttataatcatgctatttatttccttcatttttattctatttgctatctaactgatttttcattaacatgataccagaaatgaatttagatggattaattcttttccatccacgacatctggaaacacttatctcctaattaaccttactttttttttagtttgtgtgctccttcataaaatctatattgtttaaaacaaaggtcaataaatataaatatggataagtataataaatctttattggatatttctttttttaaaaaagaaataaatcttttttggatattttcgtggcagcatcataatgagagactacgtcgaaaccgctggcaaccacttttgccgcgtttaatttctttctgaggcttatataaatagatcaaaggggaaagtgagatataatacagacaaaacaagagaaaaga

SEQ ID NO: 70 - DNA, 999 bp, Arabidopsis thaliana
  misc_feature (1)..(999): Ceres Promoter YP0380
acaagtaccattcacttttttacttttcaatgtatacaatcatcatgtgataaaaaaaaaaatgtaaccaatcaacacactgagatacggccaaaaaatggtaatacataaatgtttgtaggttttgtaatttaaatactttagttaagttatgattttattatttttgcttatcacttatacgaaatcatcaatctattggtatctcttaatcccgctttttaatttccaccgcacacgcaaatcagcaaatggttccagccacgtgcatgtgaccacatattgtggtcacagtactcgtcctttttttttcttttgtaatcaataaatttcaatcctaaaacttcacacattgagcacgtcggcaacgttagctcctaaatcataacgagcaaaaaagttcaaattagggtatatgatcaattgatcatcactacatgtctacataattaatatgtattcaaccggtcggtttgttgatactcatagttaagtatatatgtgctaattagaattaggatgaatcagttcttgcaaacaactacggtttcatataatatgggagtgttatgtacaaaatgaaagaggatggatcattctgagatgttatgggctcccagtcaatcatgttttgctcgcatatgctatcttttgagtctcttcctaaactcatagaataagcacgttggttttttccaccgtcctcctcgtgaacaaaagtacaattacattttagcaaattgaaaataaccacgtggatggaccatattatatgtgatcatattgcttgtcgtcttcgttttcttttaaatgtttacaccactacttcctgacacgtgtccctattcacatcatccttgttatatcgttttacttataaaggatcacgaacaccaaaacatcaatgtgtacgtcttttgcataagaagaaacagagagcattatcaattattaacaattacacaagacagcgagattgtaaaagagtaagagagagag

SEQ ID NO: 71 - DNA, 1000 bp, Arabidopsis thaliana
  misc_feature (1)..(1000): Ceres Promoter YP0381
cacggtcaaagtattgctaacatggtcattacattgaaaaagaaaattaattgtctttactcatgtttattctatacaaataaaaatattaaccaaccatcgcactaacaaaatagaaatcttattctaatcacttaattgttgacaattaaatcattgaaaaatacacttaaatgtcaaatattcgttttgcatacttttcaatttaaatacatttaaagttcgacaagttgcgtttactatcatagaaaactaaatctcctaccaaagcgaaatgaaactactaaagcgacaggcaggttacataacctaacaaatctccacgtgtcaattaccaagagaaaaaaagagaagataagcggaacacgtggtagcacaaaaaagataatgtgatttaaattaaaaaacaaaaacaaagacacgtgacgacctgacgctgcaacatcccaccttacaacgtaataaccactgaacataagacacgtgtacgatcttgtctttgttttctcgatgaaaaccacgtgggtgctcaaagtccttgggtcagagtcttccatgattccacgtgtcgttaatgcaccaaacaagggtactttcggtattttggcttccgcaaattagacaaaacagctttttgtttgattgatttttctcttctctttttccatctaaattctctttgggctcttaatttctttttgagtgttcgttcgagatttgtcggagattttttcggtaaatgttgaaattttgtgggatttttttttatttctttattaaacttttttttattgaatttataaaaagggaaggtcgtcattaatcgaagaaatggaatcttccaaaatttgatattttgctgttttcttgggatttgaattgctctttatcatcaagaatctgttaaaatttctaatctaaaatctaagttgagaaaaagagagatctctaatttaaccggaattaatattctccgaccgaagttattatgttgcaggct

SEQ ID NO: 72 - DNA, 999 bp, Arabidopsis thaliana
  misc_feature (1)..(999): Ceres Promoter YP0384
tttaaaaaattggataaaacaccgataaaaattcacatttgcaaattttattcagtcggaatatatatttgaaacaagttttgaaatccattggacgattaaaattcattgttgagaggataaatatggatttgttcatctgaaccatgtcgttgattagtgattgactaccatgaaaaatatgttatgaaaagtataacaacttttgataaatcacatttattaacaataaatcaagacaaaatatgtcaacaataatagtagtagaagatattaattcaaattcatccgtaacaacaaaaaatcataccacaattaagtgtacagaaaaaccttttggatatatttattgtcgcttttcaatgattttcgtgaaaaggatatatttgtgtaaaataagaaggatcttgacgggtgtaaaaacatgcacaattcttaatttagaccaatcagaagacaacacgaacacttctttattataagctattaaacaaaatcttgcctattttgcttagaataatatgaagagtgactcatcagggagtggaaaatatctcaggatttgcttttagctctaacatgtcaaactatctagatgccaacaacacaaagtgcaaattcttttaatatgaaaacaacaataatatttctaatagaaaattaaaaagggaaataaaatatttttttaaaatatacaaaagaagaaggaatccatcatcaaagttttataaaattgtaatataatacaaacttgtttgcttccttgtctctccctctgtctctctcatctctcctatcttctccatatatacttcatcttcacacccaaaactccacacaaaatatctctccctctatctgcaaattttccaaagttgcatcctttcaatttccactcctctctaatataattcacattttcccactattgctgattcatttttttttgtgaattatttcaaacccacataaaaaaatctttgtttaaatttaaaacca

SEQ ID NO: 73 - DNA, 998 bp, Arabidopsis thaliana
  misc_feature (1)..(998): Ceres Promoter YP0385
actcaacaataggacaagccaaaaaaattccaattattgtgttactctattcttctaaatttgaacactaatagactatgacatatgagtatataatgtgaagtcttaagatattttcatgtgggagatgaataggccaagttggagtctgcaaacaagaagctcttgagccacgacataagccaagttgatgaccgtaattaatgaaactaaatgtgtgtggttatatattagggacccatggccatatacacaatttttgtttctgtcgatagcatgcgtttatatatatttctaaaaaaactaacatatttactggatttgagttcgaatattgacactaatataaactacgtaccaaactacatatgtttatctatatttgattgatcgaagaattctgaactgttttagaaaatttcaatacacttaacttcatcttacaacggtaaaagaaatcaccactagacaaacaatgcctcataatgtctcgaaccctcaaactcaagagtatacattttactagattagagaatttgatatcctcaagttgccaaagaattggaagcttttgttaccaaacttagaaacagaagaagccacaaaaaaagacaaagggagttaaagattgaagtgatgcatttgtctaagtgtgaaaggtctcaagtctcaactttgaaccataataacattactcacactccctttttttttctttttttttcccaaagtaccctttttaattccctctataacccactcactccattccctctttctgtcactgattcaacacgtggccacactgatgggatccacctttcctcttacccacctcccggtttatataaacccttcacaacacttcatcgctctcaaaccaactctctcttctctcttctctcctctcttctacaagaagaaaaaaaacagagcctttacacatctcaaaatcgaacttactttaaccaccaaatactgattgaacacacttgaaa

SEQ ID NO: 74 - DNA, 1000 bp, Arabidopsis thaliana
  misc_feature (1)..(1000): Ceres Promoter YP0396
catagtaaaagtgaatttaatcatactaagtaaaataagataaaacatgttatttgaatttgaatatcgtgggatgcgtatttcggtatttgattaaaggtctggaaaccggagctcctataacccgaataaaaatgcataacatgttcttccccaacgaggcgagcgggtcagggcactagggtcattgcaggcagctcataaagtcatgatcatctaggagatcaaattgtatgtcggccttctcaaaattacctctaagaatctcaaacccaatcatagaacctctaaaaagacaaagtcgtcgctttagaatgggttcggtttttggaaccatatttcacgtcaatttaatgtttagtataatttctgaacaacagaattttggatttatttgcacgtatacaaatatctaattaataaggacgactcgtgactatccttacattaagtttcactgtcgaaataacatagtacaatacttgtcgttaatttccacgtctcaagtctataccgtcatttacggagaaagaacatctctgtttttcatccaaactactattctcactttgtctatatatttaaaattaagtaaaaaagactcaatagtccaataaaatgatgaccaaatgagaagatggttttgtgccagattttaggaaaagtgagtcaaggtttcacatctcaaatttgactgcataatcttcgccattaacaacggcattatatatgtcaagccaattttccatgttgcgtacttttctattgaggtgaaaatatgggtttgttgattaatcaaagagtttgcctaactaatataactacgactttttcagtgaccattccatgtaaactctgcttagtgtttcatttgtcaacaatattgtcgttactcattaaatcaaggaaaaatatacaattgtataattttcttatattttaaaattaattttgatgtattacccctttataaataggctatcgctacaacaccaataac

SEQ ID NO: 75 - DNA, 1514 bp, Arabidopsis thaliana
  misc_feature (1)..(1514): Ceres Promoter p13879
tttcgatcctcttcttttttaggtttcttgatttgatgatcgccgccagtagagccgtcgtcggaagtttcagagattaaaaccatcaccgtgtgagttggtagcgaattaacggaaagtctaagtcaagattttttaaaaagaaatttatgtgtgaaaagaagccgttgtgtatatttatataatttagaaaatgtttcatcattttaattaaaaaattaataatttgtagaagaaagaagcattttttatacataaatcatttaccttctttactgtgtttttcttcacttacttcatttttacttttttacaaaaaagtgaaaagtaaattacgtaattggtaacataaattcactttaaatttgcatatgttttgttttcttcggaaactatatcgaaaagcaaacggaaagaacttcacaaaaaaccctagctaactaaagacgcatgtgttcttcttattcttcatatatcctctgtttcttgtgttctgttttgagtcttacattttcaatatctgactctgattactatatctaaaagggaacatgaagaacttgagaccatgttaaactgtacaatgccttcaaacatggctaactaaagatacattagatggctttacagtgtgtaatgcttattatctttaggttttttaaatcccttgtattaagttatttaccaaattatgttcttgtactgcttattggcttggttgttgtgtgctttgtaaacaacacctttggctttatttcatcctttgtaaacctactggtctttgttcagctcctcttggaagtgagtttgtatgcctggaacgggttttaatggagtgtttatcgacaaaaaaaaaatgtagcttttgaaatcacagagagtagttttatattcaaattacatgcatgcaactaagtagcaacaaagttgatatggccgagttggtctaaggcgccagattaaggttctggtccgaaagggcgtgggttcaaatcccactgtcaacattctctttttctcaaattaatatttttctgcctcaatggttcaggcccaattatactagactactatcgcgactaaaatagggactagccgaattgatccggcccagtatcagttgtgtatcaccacgttatttcaaatttcaaactaagggataaagatgtcatttgacatatgagatatttttttgctccactgagatatttttctttgtcccaagataaaatatcttttctcgcatcgtcgtctttccatttgcgcattaaaccaaaaagtgtcacgtgatatgtccccaaccactacgaattttaactacagatttaaccatggttaaaccagaattcacgtaaaccgactctaaacctagaaaatatctaaaccttggttaatatctcagcccccttataaataacgagacttcgtctacatcgttctacacatctcactgctcactactctcactgtaatcccttagatcttcttttcaaatttcaccattgcactggatg

SEQ ID NO: 76 - DNA, 1954 bp, Arabidopsis thaliana
  misc_feature (1)..(1954): Ceres Promoter p326
gtgggtaaaagtatccttctttgtgcatttggtatttttaagcatgtaataagaaaaaccaaaatagacggctggtatttaataaaaggagactaatgtatgtatagtatatgatttgtgtggaatataataaagttgtaaaatatagatgtgaagcgagtatctatcttttgactttcaaaggtgatcgatcgtgttctttgtgatagttttggtcgtcggtctacaagtcaacaaccaccttgaagttttcgcgtctcggtttcctcttcgcatctggtatccaatagcatacatataccagtgcggaaaatggcgaagactagtgggcttgaaccataaggtttggccccaatacggattccaaacaacaagcctagcgcagtcttttgggatgcataagactaaactgtcgcagtgatagacgtaagatatatcgacttgattggaatcgtctaagctaataagtttaccttgaccgtttatagttgcgtcaacgtccttatggagattgatgcccatcaaataaacctgaaaatccatcaccatgaccaccataaactcccttgctgccgctgctttggcttgagcaaggtgtttccttgtaaagctccgatctttggataaagtgttccactttttgcaagtagctctgacccctctcagagatgtcaccggaatcttagacagaacctcctctgccaaatcacttggaagatcggacaatgtcatcatttttgcaggtaatttctccttcgttgctgctttggcttgagcacggtgcttctttgtaaagctccgatctttggataagagcggatcggaatcctctaggaggtgccagtcccttgacctattaatttatagaaggttttagtgtattttgttccaatttcttctctaacttaacaaataacaactgcctcatagtcatgggcttcaaattttatcgcttggtgtatttcgttatttgcaaggccttggcccattttgagcccaataactaaatctagccttttcagaccggacatgaacttcgcatattggcgtaactgtgcagttttacctttttcggatcagacaagatcagatttagaccacccaacaatagtcagtcatatttgacaacctaagctagccgacactactaaaaagcaaacaaaagaagaattctatgttgtcattttaccggtggcaagtggacccttctataaaagagtaaagagacagcctgtgtgtgtataatctctaattatgttcaccgacacaatcacacaaacccttctctaatcacacaacttcttcatgatttacgacattaattatcattaactctttaaattcactttacatgctcaaaaatatctaatttgcagcattaatttgagtaccgataactattattataatcgtcgtgattcgcaatcttcttcattagatgctgtcaagttgtactcgcacgcggtggtccagtgaagcaaatccaacggtttaaaaccttcttacatttctagatctaatctgaaccgtcagatatctagatctcattgtctgaacacagttagatgaaactgggaatgaatctggacgaaattacgatcttacaccaaccccctcgacgagctcgtatatataaagcttatacgctcctccttcaccttcgtactactactaccaccacatttctttagctcaaccttcattactaatctccttttaaggtatgttcacttttcttcgattcatactttctcaagattcctgcatttctgtagaatttgaaccaagtgtcgatttttgtttgagagaagtgttgatttatagatctggttattgaatctagattccaatttttaattgattcgagtttgttatgtgtgtttatactacttctcattgatcttgtttgatttctctgctctgtattaggtttctttcgtgaatcagatcggaa

SEQ ID NO: 77 - DNA, 2016 bp, Arabidopsis thaliana
  misc_feature (1)..(2016): Ceres Promoter p32449
gatcggccttcttcaggtcttctctgtagctctgttacttctatcacagttatcgggtatttgagaaaaaagagttagctaaaatgaatttctccatataatcatggtttactacaggtttacttgattcgcgttagctttatctgcatccaaagttttttccatgatgttatgtcatatgtgataccgttactatgtttataactttatacagtctggttcactggagtttctgtgattatgttgagtacatactcattcatcctttggtaactctcaagtttaggttgtttgaattgcctctgttgtgatacttattgtctattgcatcaatcttctaatgcaccaccctagactatttgaacaaagagctgtttcattcttaaacctctgtgtctccttgctaaatggtcatgctttaatgtcttcacctgtctttctcttctatagatatgtagtcttgctagatagttagttctacagctctcttttgtagtcttgttagagagttagttgagatattacctcttaaaagtatccttgaacgctttccggttatgaccaatttgttgtagctccttgtaagtagaacttactgggaccagcgagacagtttatgtgaatgttcatgcttaagtgtcgaacgtatctatctctactatagctctgtagtcttgttagacagttagttttatatctccatttttttgtagtcttgctagttgagatattacctcttctcttcaaagtatccttgaacgctcaccggttatgaaatctctacactatagctctgtagtcttgctagatagttagttctttagctctctttttgtagcctagttctttagctctccttttgtagccttgctacagagtaagatgggatattacctccttgaacgctctccggttatgaccaatttgttgtagctccttgtaagtagaacttaggatagagtgagtcaactttaagaaagaacctagtatgtggcataaccagattgcaggctctgtctcggctacagtaacgtaactctatagctctttgttttgttcagaaagaaccagtgattggatgattcgtccttagaaactggacctaacaacagtcattggctttgaaatcaagccacaacaatgcctatatgaaccgtccatttcatttatccgtttcaaaccagcccattacatttcgtcccattgataaccaaaagcggttcaatcagattatgttttaattttaccaaattctttatgaagtttaaattatactcacattaaaaggattattggataatgtaaaaattctgaacaattactgattttggaaaattaacaaatattctttgaaatagaagaaaaagcctttttccttttgacaacaacatataaaatcatactcccattaaaaagattttaatgtaaaattctgaatataagatattttttacaacaacaaccaaaaatatttatttttttccttttttacagcaacaagaaggaaaaacttttttttttgtcaagaaaaggggagattatgtaaacagataaaacagggaaaataactaaccgaactctcttaattaacatcttcaaataaggaaaattatgatccgcatatttaggaagatcaatgcattaaaacaacttgcacgtggaaagagagactatacgctccacacaagttgcactaatggtacctctcacaaaccaatcaaaatactgaataatgccaacgtgtacaaattagggttttacctcacaaccatcgaacattctcgaaacattttaaacagcctggcgccatagatctaaactctcatcgaccaatttttgaccgtccgatggaaactctagcctcaacccaaaactctatataaagaaatcttttccttcgttattgcttaccaaatacaaaccctagccgccttattcgtcttcttcgttctctagttttttcctcagtctctgttcttagatcccttgtagtttccaaatcttccgataaggcct

SEQ ID NO: 78 - DNA, 667 bp, Arabidopsis thaliana
  misc_feature (1)..(667): Ceres Promoter PD1367
acagttttcttttctcatcttacaacaagtttccaggaggatagagacataaacgaagctcggattgtatcgttctttttagcttttattcacatccgaaagtcctgtagtttagattctgttatcttgcggttttgagttaatcagaaacagagtaatcaatgtaatgttgcaggctagatctttcatctttggaaatttgtttttttctcatgcaatttctttagcttgaccatgagtgactaaaagatcaatcagtagcaatgatttgatttggctaagagacatttgtccacttggcatcttgatttggatggttacaacttgcaagacccaattggatacttgctatgacaactccaactcaagagtgtcgtgtaactaagaaccttgactaatttgtaatttcaatcccaagtcatgttactatatgtttttttgtttgtattattttctctcctacaattaagctctttgacgtacgtaatctccggaaccaactcctatatccaccatttactccacgttgtctccaattattggacgttgaaacttgacacaacgtaaacgtatctacgtggttgattgtatgtacatatgtacaaacgtacacctttctcctctttcacttcatcacttggcttgtgaattcattaattcctgcgaa

SEQ ID NO: 79 - DNA, 1836 bp, Oryza sativa
  misc_feature (1)..(1836): Ceres Promoter p530c10
gcctctcgaccacgagtttagcacttgtgcaacatatatgcgtgcgatgaacatctactgatgcgccatgcgaattttagcgttcgttcatgacgcttccaacggcacagaggctgagcagcagcatgcatgcatggctcttgtgaaaacaaaaaaggttactggtaaatgacatgctgctgtagctagctagcagaatgcaaggcccatgcatatgcaatgctatgcgacaagtacagtaccagcatgtatggtagccagctaactaatctatcagcagaggcagcaagctcgtgcatggtgtgatgcacttctctccagtaatctagtggtaattttcacccaaagcgttgctcatatggacagtaattagtaatattaccaaggttcacaatcccgttacctgaccaaatactactcacgaatggtatctctggttttcgttaaaaccgttggtaaaccagcaaaaatagacaaaatttgtcaaaattttaaattttagttttttttttttaacttagccgggaaaccttgaagtttgtgctgtcgagctgtcctgggaaggacggttttggttgggattgtgaaccctggttactgcacttcatttttgaacagatattagtgcaacagacaaatgccaacgcatttttttctgtttaccggcaagctgaagcttttacgatccccatacagccgttgctgcaaacctgccaagaaagagcagcagaaacaggtgtcattttgtggtggaaagccaagtaaagtaaacagaagatggaagatagtgaggaccagggagtgaggcaggggacacatggcccacgcctccctgcacattttcgtgtataaatacaggtggatgcatcgctctcccagcatccatcggttctctgctctgttcatccatagagtttcctcctcttctcctttagtgcaaggtagagaagagcatgtgtgtgtgtgtgtgtgtgtgaactgtgaagtgcagagtgcttctgtagttctgtgttatgtccatagtgatcttgttaggattgttgctatggatgcatgatgttatggttgatctctgaattacagtagggacttttctgagatctctggattagtggggggtgctaaatttttttctggttgcatcagcttgggtttctggtattggtgtgggttcttgctctgaattttggttcagaatgtcgatttgtttgtgtttgttctctgaagttgagagtagctatgatccatccagcacagaactgcaggtcctgcctgccggctgcatatacaggacatgccattttgcaagctctgggcttatggtttctcttttggagttcttcttcttgcatgatctgtgttctctaacaaaggaagcaagatttagcaactttattcagagacaagaaaaggatctggcaaccttttgtttctgttttatcctactcgtaaagattgttatttaagcaaaaatttcccaaaagttttaaatataatttccatgatgtgccactctcatgtccttgaacctggcactcattatgggctcctcagaagtgctgtagctaatgtcactaatcttttgtatctttgttcatagtcttgtattttatgatgcttatccctttgtgctttccatgtttgatgtccaaatgtcatggcaatgtttttgacttctagtaggggttttagtacctttttgttagataagtacatccaaattctgtttatttattcaaaaatcattctgtttattcactgaaaacatttgtccattcaatggactcataaactgtctgtgtttttcaggcttgaggatccatctagaagatagca

SEQ ID NO: 80 - DNA, 3000 bp, Oryza sativa
  misc_feature (1)..(3000): Ceres Promoter pOsFIE2-2
gcttaacacatgaactaccaaaatatactgatcactttgttctagtcatacataccttaagtcattttattctgcagtgtttggattggagggagcattctagcatcccttgggtcgttccagcaaatgtggttctccaaagcagagtaagcacaacacagtattttaggttatgtttcccctatctcgtcacggacagctcacaagttaatgtgatttatctcactatagatacgaagaacatggagtatcctacatccaaaggaagtgcccatgaagttgtggagcatcgctacgatttgtgaccaaatttgggtgcatgtgggcaatcgtattacagccaccctgttgttgatctatatcgactattatccgacgatatttatcattatattatgactagttagtttgtagattttgagagggcaacataagaagcaatccagcttaacctgttatgttcttgatggtagattctagttcatgtgttgaatctgttctccctgctgtagaatgtatcgagttgctgctctctactctgtacttttagaataccttttcaatcatttggagtcagctgattgttgtactacttatacgccacctgattagtcatgtcaacaattaaacttgagcactggttaagttaagagtggcctgattgtagttgataatcacattttattcgtagacattgtatgctggatctttatcagccaccgtcagatcatcctctgtaataaatcttcatcagacgtgtgtgccaatcgcaaggaacacgaaatgcatccgaaatgttactctgagttaatcaatactataattcttggtcaaattaattatttatatctataaagtttaaattaaatttaggaaaatgaattcatgcaaatcttgtggtaagttgtcaatttcataaaaaatccagcttactactccctttttaggagtgtgttgtggctgcacacttctgccttttgatatatacggttctattctcggtgtactcctttattattattaaaacaatcccagttacttggtaagtgctaatcacgaatcaaagtcaacataacaaatcatgtgcgtacagctataactcgattacacaaacaacaaaattcatatttgaacataaatccagttgtagcatatctggtagtataaagttttttttttgtatagaagagttttaatttctgtaagttttggaaagcatttaatcctagaaattgtagtgtagctcaactaaaaaataaatgaacttgaatcgaaattgggttgtatcataaatctttaccactcaaacgaatatttatcctaaaccacaaatgactcttttcatcaaggaatgttttgttttcagcattttaaaaaaaaacttttctaatatggttttcatgtttcgttcttttgaaatttaacatctatttaatttgcacggctccataaattcaacggatacatattctgaataattactaaggaggcatatatcggctctcttaatacaaccgcttgtttctcaaaatttattttgagttttgtctacacattctcaaggacggtacaaacacactatagatgttcacaattttttttttctaaagttgattgatggacaaatgtttgaacatataaacatataagcactgaatatttgcttatgcaggaggtatttatatcaagttcgatactttactaccatagtccctaggacactaaaatgccttcaatgatctgatgaagcctaagagagaatattgatcagtggagcgacttgcaactacacatggcacaagtagactagacacggtatatattcatattaacttgttaaaattttactacttaacagttcacttgtggtgcatccatatcaattcttacttacacaatatttgtaaaaacaacctaacactataggatgacctagacaacctttatgtcaatcacacttagaagatgatcgtctttttaataaataatgtgtactacacaccatgctctccatatagatcaagatctacaaacccttccacttataaaccttaccaccaaaaactcattaagttgcttcatttatctatgctattaagaaaaaaacttatttcgtttatgccatttctagaaatggctagtcacactattcacaatattatataataaataaaagtttcaaatattcatccaccaaaaatcatcaagtcgtgggacttatatgttaattagagaagtccctttgggtgcaatcgattttggaaaccctaaattttttctatacatagaagagagagatgtctagttgcaattgcttttgcgatgtgccaaccacccttctagctttcatccacgtctacttaattgccattcttcttcttctttttcttcactattactacctcctatcttagcgaatcttcttcttcttcactattactacctcccaccttagtgaattcatcctcattgttcacaatgacattgctaagttaactaggtatgctaagtacacaattagaatataacctagagcctttgtttccatcatacttaaaagatgacatttttatatagataaagtgtgctactcacaaggcttactatatatatgtatgatacacacaaactccacaacccaaaactctttcaagttgtgtggcccatctatgctattaaaaagcccatttagcccatccaacatgagaaaccctagggttttttccctataaaagatacctaggttattgttgcttttccaccccgcccgccgccgctccctattcctatttaatcccatctctcttcctcatcaccgctctcctctctccaggcaagaggtacgcactttttgtttcggatttgaaatctttgcttcgttttactatcattggtcataagttcttttttgaagatgtttgagaataagtttatcattgagattatcgtcacttgtgataggaagtacgcaacctcaagccggacaagacgtgagcaaag

SEQ ID NO: 81 - DNA, 2023 bp, Oryza sativa
  misc_feature (1)..(2023): Ceres Promoter pOsMEA
gagagcagaacatagtagccgctgttttctgggggtgcaatttgtgcaagatcgctatccttatggaccatgcaagcaccaagcaatattaagccaggtccaacagcggtcttggggaattcagaaatgagcttaaaaacctccttgagctggccagctcagccaaggaggtccatcatgcatgtgcatgctcaatacttggaattattgcaaaatgatcggtcattgactggaagactttgcgcccttcctcagccaaccttatgtggctgcatgcatagagtaccaacaggaaggtagcgtttgttggaataaggtttgcatccagcatgtccttgtagagcttcaaagcctcagcaccttggcccatgaaggccatatccagctaattgcattccatgagaccacattcttgctatccatactgttgaagtgaagatgctccgagcttcggaaatgcttccacactatgcatacatgtcaatgagcactgtcatgacataaacattgggccccaagtcctcctcagcgataatcctatgcagccactttcccagggacaaagctccaagctgtgcacacgctgaaagagagctagaaatgatgattggatttggtcacacgctaagtaccagcatttgctcaaagagggcaattgccatctccgtccagccattctaggcataccctggtattattgctttccatgattccgattccgtggtcttctatggcatcgcattgaaggccttccttgcagactccatatcatttaacctacagtacaatatggtaattgctgtcgacactggagaattcgcagtaaatccagacttgagaggaccatgtaagcattgatcaagcagttcattcccaaacagactatacgggatcagtgccagtgctcgagtttggcttcaattccaaggccatcaacccaataaacagattaactgatgaaccaaccatgcaattcgccgagcaaacatagattaagcattgtaggcaaccaaatctggattctccatcaagtcaaagagacgccatgcagaattccacatccccgctgtatacaccgagatcaaccggtcagaacatgctcatactccgccaaccctctcttcagaacatgctcatactccgccaaccctctcttctctgcaagaggcatcctccccaattccccattgttatatctgttgctggtaagaccgttgccagcgtggttgtgtcagaccgaacagactctgcactcgccatcctcacgaacgactccagggcctccgaaccaggaagcccggccggccatcagcgtgttccacataacggtatccggcgactgcacagtgtcgaacaccttgcgtgcgtggtcacctctggacagcatgaagcgtacaggctacagcttggccaatgcggacgccacgaacgtgtcggcggcgtaacccgcgcgtgcagcgcgccgcgcgcgggctgcggagtcggttggagacgacacgccgccgccatgagagcaatgagcgaggtggcggcgaaggcgaaggagaagtagtcgaggcaagcggaagagaaggcggcagcggagaaagcgatcggggcggcggaggaggtgggtgggagggagggacgcgtagcggaggtcggaggaggagggagctgaggtttccggggcgggggtcgagagggtagtgtacggaggcgagggacacggcgaggatctggtcgaggtagcgcagtgtgaaggaaagcgcgatgaggcggagggcgccggcgaagagcggcgcggcggatagcgggaggaggcggcgccggcggggtctcatccgattggaaacagattgggaagggggagggggtaggaatacgtggcgtcggcagtattaggtagagagagaaaccctttccatcctttgtctcttagccccgaaggagagagaaaaatcagaaaaaaaaaaccctccgcgtgtgggggaagcagagctccggacgctggcgccgctcgcgccaccgcacccgcaccgcc

SEQ ID NO: 82 - DNA, 2034 bp, Oryza sativa
  misc_feature (1)..(2034): Ceres Promoter pOsYp102
gaacgacccaaacgcgtaaatggtggtactggtttccctgctttgccgagtaccagcagccacgaagaacgttacacaatcgagtacaaaatctataagagcaagtttaatagcatagccaaatactacctctaaatcatctatagccaatttaatagttcatttattcaataattacttataaacatatactacaatcattaatatatggtcttacttcttatacacataatattttggagtccgtgttacagctggctataaatataagggattttggttggatgtggtacatcctattataatgaatctagacatgaaacctgtccaaattcatcgtgctaggatacgccacatctaaccaaaatctcttatctttagggatggagagagtaataattaaatgaagctaggtagagtttcccggtcaatacgcttgcgtgtgcttataagagcatggccaacagtttcccgatactcttcccaatatcagttttgaggagttttgttggaaaaaatcgctccaacagtagacctaaatcacccctaaaagcttggcgtttccaaacccgcatatttcgttctccacttgtagggaagagactcggcgcccaatccttcaaccgcatgcacttcgcgcgcgctgtgtgaaaattttcctaccaggttcttctttgtgcgttcgtctacctgtgagtcaatccatcacgccagcagcctcatcttccccgcagctgtctgggaaagcagccatggctcccccaagcttccccagcgtcgacatttttttctcagcggcagcgccagacccatctccaacccaattgggcggaccttcgtcggcgctcccccagcaccaccaccgactcgaatcggccgtcgcccctattcatctccaatcgtccctcgaccctaccgcatcctgcagcacagcctgtctctcgcgtcagactggcgctgcgctccccccggtaatgtgcaggcgacaaaggccccatgcgatgcgaccagcagccggcgacaaccggaggtgcccagtcgctggccttcatcgaatcatcgtgcacctcggtcggagtcgatttctgattgttgctgctgctcaaatctggagcttgctattgctgagaactgcttggtggtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgcgcgagcgtgagtggaggagaggaatgacgattctgttggtagttgtcgatgtggcctactttttttgttttgaggattaaattttgggaatctcttggagataaaaggtattctcataccttaaatcctttttagagatctaaaaaaaatgatttaggggattgaattttgggtggctgttggtgatgctctaagttgcacatcctggggaaaaacctccctaatccatcagcaaaccgatcaaccacccacgacaagtcgacgccaccgttttttttttctccctcctaagtcctaaccccacaaaaatcccgcgaactttcgtctcaccacgcgccgcgtgccccctacaaataccaaacaacacccaccacgtccactcacaaaccacgcaggaaacctcagaaaatcaccgtacgcgacgcgggcccaagaaaaccccgacagaaaccgcgcagcagcaacaccaccaccggcgtcggag

SEQ ID NO: 83 - DNA, 1877 bp, Oryza sativa
  misc_feature (1)..(1877): Ceres Promoter pOsYp285
ggcccgagttaaacgatcttccacgtgtcagcgaatcctagtcgttcgatgaatctgaatctgacttgtggtggttggacggccacgtgttaaaaaagggaaacgtccgcatcacccgatgctgggacatttgcaatttcgatccagctgtagattgaccagttgttactctcttttttttaacaccatacaaacgtaatactccctctgtcccaaaatataagtattttttttaacctcggttcagtcttcgaggtgctactttgaccaataatatttataaaaataagatgttttaaataaagagagttgcatattatgatagctcgtttaatgataaacaaagtaccatcaaatttacatgattaatctttttaatttatttgctattaatagttaaaatttaaaaagtttgacttcacactgttctaaaaatacttatattttgggacggagggagtacacattagagcaggtacaatagcagactagtagccagctataaacatattttaatgagataaaagatgagagagaacagcgggctacagatctgtagccagctgcagcacggactccaagacattgtgtgtgtatgacaggtgggaccatatattaatagtacagtaagtaactattgtatgaattggctattagattagctataggtgaattgtagctagtagtgggctatactattgaacttactcttatatctctcaatatctccagaaaactaggacgatatatattgatattaacaaagtcatcatagatatctcgctatcgacatatatattacctatcactgaaaaaataattaatcataaatgcaagcacatatactacgttcaacactgaatgtaggtagattggtagacgggttccaccgcaagaaaagcattgcaccagtgaagaaagaaacatcggaatttgtatgtagtttgttgtttgatgaattcttttgattaaaaaaaactaaaatcagagttgattcagttaatggtgttgcctacgatatacttccatatcatgatatcactgtagactatgaatcatatctttaattaaaactaaatcaagaaattaagtatgagacctcaactcaatgaagaatttctagttgaaaaacattcctagtgtgcgttcggatggaggtagggatcttctctccgttcatataaaaccggatggttcattagaacatgattaattaagcaacagttaatctaaaaataaattaatattttttaagaaatttttgtatagagatcttttgaaaaaaatacattggttagaaagcatactaataaaaagagaaaaataagaacatagtactatagtagaaaatgagaacttggagtatttgagaggatgggaaataagaagattaagaagatgcgtaaagtgaacggttaacgcatgattgattaattaaatattaattattttaaatttggaaaataaattagtatgatttttaagcaacatatatatatatatatatatatatatagaaaaacatagttttagaaaatataagcgtgtaaaacgatatgcaggaacgaaacgttgagcattcaaaatttcaaattgaacatatgaatcaagagagaataaaaaaagaggccttctaggctggcatggacaattggacatgttttcaactagggtttcaagcttcgagcatccacttttgtccttgcaaactttatacggcaaggcccgtgaatctagccccccacaccaccccacccgcccgcgccgcgcggccgcctcgcctcccctcccttctcctcctctccgcccccgccgccaggccgtccacctccgccgtctcctcccccattcgcacccaaggcgctggcgcggaaggc

SEQ ID NO: 84 - DNA, 1000 bp, Arabidopsis thaliana
  misc_feature (1)..(1000): Ceres Promoter PT0565
caccaaatatagtgttatttcaatactaaaatggtgttatggttggagatgccctaaagataaacatgacgagacacgagatttattaatttcttgatcaaccataacttaataacttaatattaatttcacttaataatttccaattaagtgaatctttacttcaccaaaagttcctaacgaactcttattttctagcatcaatattaccatgaactagcatcaatactatcatgaaaaattcctacttcctatccaactcttaataacaatgctagtcttaacaatattcatcaaaaacttgatatagaccttctaacttagccacgactagtatcggtgaataccaaaattaatgtattcatgagaacttgagatttctctaatgtattcttgttactaaacaagtaacaacactcaagaaatatcatgatcaaatattttactcataaactccatatttcacattttgaaaattttaaacagcaaatcacattgaattttcgtggtaaaagtatttaaaattgaaaaatagcagctcctgatttcaatgtataaatttatctttatatggtttatgtctccaacttattttaaaaaagagagaaagagcacccaaaaggtgaccgtttgaaattcgaatttatttccgtttgaaattcgaattcaaaaaaagtaaaccgaaccgagtctcgttactgactgtcacacattgtttccctaaaagctaattaacccatacgtggcgtaatataacaggtcagtgatcaatactaaataacagacatacacctttaaaattcgtgcacgctccaaaacaaaatctacacttcaaaatcaacggtcacgatcattcctcaaatttcaaaaaattatttaacctcacttccttcgctttgtttttaaaacctctctctctttctctttctctttcgccattaaaactctgtttcctttttcagagattctcagagaagattcattttaccctaagaaaaaa

SEQ ID NO: 85 - DNA, 999 bp, Arabidopsis thaliana
  misc_feature (1)..(999): Ceres Promoter YP0015
ttgagccttattgttgttattgacttttagccaatagaaagagatggaaattcaataattatccacaaaattccaaatcattggtgtacaaaaagatctaaggctgttatattttcaaaaaagaaagaaaagaaatgcaacaaatatggattaaactgtggtttgtaaattgagctttgcatgaaaactttatcactatgatttcactactccatatttattgactaaagtggcactaatgaatttcttaatcatgaaatcttgtatcaaaaagtactaaaataaacatgacattggcaattaggaaaattctaaattagaaattagtaaaaatgaaaggtgaaagggaaagatgatgatatgaattggttggtgaccaggagaaatgtatcccgatttttgcagacactttcagtgtccccattcatataattatggcccacctcgttaagatttttcattcaccaccataacaagatctaagcttagatttcatgtaattaaacatataatatacttgccaatactatctaataaagtatacttaagcaaaaattattactctagtgtaaggcgatgaaatataagtttagttgaaaatttatgtcgatataacaaagtataatgaattaagaccttggttttcgattaacaaactaattaaacactagttttgcctaataaaaccgggaatcgtattcaaaaccgaacgacaaaacaagggacaagttgagagacaaaaccaaatcagcatctttcttccagaaatgtcatgaccacatgacgtcatcttgacccttcttcattgtgatatctgtggataaagcgcacgtgtttaattcacgaaccttcgtagtaacgaaaaatccacaactttcatattttttaattacccactaaactaaaacaaatttggaaaaacatgaaaaactttttctttttttccaggttcgtgaacctcgtaccctctatataaacctcttaaccaccttccacata

SEQ ID NO: 86 - DNA, 999 bp, Arabidopsis thaliana
  misc_feature (1)..(999): Ceres Promoter YP0087
tgaattgagtaaaatgtgttttcaaacagttaggtggtagaaggtaaaggtaataacatcatgatcttactaaaagaattgttgcatactaactatcaatattctcaacaacataatataatgtttttttaggtaattttccattttaattttttgtgattaaacaattaaacaactcgaatgatgatgataaaaaaaaaaaattaacaactcgaataagttaaagtagcaatacacatgtcgttcaattcaaccaataaagtaagacttatatttttaagaagttgactaatagcttaataagttggaaaacttgtgtagtttcttaattcccacgtgcagtaagaaataaaaatgaaaaaaattattatatccttcccactctgcgacttttcttttattttatcaaatattaaaaagattcatatcacagtttacacattgaaatcataaacgataattatgtattttgtaataaaaagttagttctgaagctcatactttggatagtcgctagtcgctaatatgctccttgtaataattaaagtcactacgacgcacgtcaaagccgatatttagggcttaattgatgcgtgtttttcttttcatataatagtaatataaattagtactaataaagtatgatggatggttgagacagaaaagaaaaaagatgactgtatggtcatcattacaaagaagaatgtattcttcatgttcttaagaataataaaatgtcacttgtaaatcaagttggtaagcattttgagaactttgttcgatgcaacgtatgatgatttatgtagacaaaagataaaaccgtatcttcaactattgccaagaaaagataaaacctaatctagtcagtctctcaacataaatacaacccaatagccaaactgtgtccaattcggagagaaactaaactaaaacaaaacacaaaagcccaacataagcccaataaaacccattttataaacagaacattactaacactca

SEQ ID NO: 87 - DNA, 1000 bp, Arabidopsis thaliana
  misc_feature (1)..(1000): Ceres Promoter YP0093
atgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttactaattttcacaga

SEQ ID NO: 88 - DNA, 999 bp, Arabidopsis thaliana
  misc_feature (1)..(999): Ceres Promoter YP0108
ttagctgaaccaggaaattgatctcttataccagtttccgggtttagattggtttgatggcgatttgattaaacccccgaaattttatgtcgtagttgtgcatagtattattattctttgcggacaatagacgtatcgggaccaagttctgtagcaaaattgtataagcttaagtttgatgaaatttaaaggtaatcactaaaacccaaatgggacaataaaccggtgaagatttagagtttttaattttgactcatgaatctggagaaagagccctcgttaaaaggagtgaatcaatccataggggaaaaagttttgtctttttaaaaactaaagaaccaaaccttaatagaagcagctcaatgtgtgacaactttccactggcactaagataaagtgactagcgatgagtgcaattattgaaatagtagatggtaaatattacatacaagagtaaaaatatctttatgtcaatgcttaattcagtgtttctggttaacaagagaaacttctctaactttcgtaattgggtcttataaaattttatgcaattatgattttacccttttactacttttcattagctttcacgaatctattttgacaagagaaatcattagaggtaaacatgctttttggtcaagggccttaacagttccaccaatcaagctcaaaagttgtacttaaccgacatcttctgtgaaaacatataattacatgtacaaatcaaaactaccttatgaaataaatagaaatattgcagttcatttctaatttaacctcttcaacttttaaaactatttacatttctttatgtcatttctagtcattttgatgcaaattgtaccatttatggattatcttcacaaatttttaagttggtgaaaactttttggtgggtagttaaaacttgaaatagaaatttactttaccaaaataaactaatgaaaagtaatcactccactccctataataagatttccaacgttcccactaagc

SEQ ID NO: 89 - DNA, 999 bp, Arabidopsis thaliana
  misc_feature (1)..(999): Ceres Promoter YP0022
tagttccattacaatttccaaatgatttgttacaaagctacaagattattcgaaataggatttcatccataagagagaatggtgtggtcgacgctacaatgttgatttattggttgtggtttgcatcttggggatgtcaaatcctaagtttcaagttcttgtaaaaacgttttcaggtttctttaatatattttaatattaatgtaaaaagaaaagatatagcttttgtacaaaaaaatttgtttaatcactatgtaggaggatgcgatcaaattcatggaatgatgtattattagcttttctatcctcactctaaaaacaatactatagtgagttaaataatttgatcatttcaatgtagattaaaattttattaaaagaagaaaaatttaaaagcctataacaaaataaaaaaggaggctcgaggtatgatgggtgtagcagaagagctggcaacagctatcgactgagtgattacgaactcagtactcagtgttctcagctcacacactctttttttgttctctttcttttggacagctttcattttctcttttcttttttctattttgtttcaaaattccatccatattaaaataggcctgatcatgagaataaaggaaatactaatgatgagtttctcaataatgcaataagatgcaattattatgagctatttactattgaaaatgagcaaataaatgtcaaaacacaatctggttaagttagagcaactccattgtataggattcatgtagtttctaagaaaacaaaatgtattaatattttacttttacatccaaaaaaccaacttatatgagtaatagaaacgatcctaatattaggaattttagagattttctctcatctgtttcttaacttttcaatatttttattttttaaaattgtatgagtttctactaagaaactactgctggagttggtcttagcttcccaatgcttctccacctatatatatgcatatctccttcttaaaac

SEQ ID NO: 90 - DNA, 999 bp, Arabidopsis thaliana
  misc_feature (1)..(999): Ceres Promoter YP0080
aagcggcaatttagtaagaagtactcaaagtatcatttaccaaaagtatatggttttgggaagagttgttagggatgtattctttctaaacagatgatatgacgatgttcttgaaaactaatgttaaagacggaatctctggcatcttcactcgggagatatattaaaccgttgattgtagttagccatgtacttagcttagtgcacaaataatctgctgcaagaaatctttttctattataatatctctcatttaaacattagaacatattgtttaacttgttcttctagaaataaaactgctaatttcttatggtaaactattttcctttagattgcacaatcgaactcgaaaatctagtggagactatgtgactatgtttatatatatgaaacctaaatcaaattatcccaataattgggagacacaaaagaaaaattacgaaagaaaacaggaaatcaaatcaaaagataaagagaaggtaaaaaaaggcaagaagcactaatgtttaatatttatagttttctccattaaagaaaaagcgatgatgtgtgttctcatcttttgtgaaagtatatatattgcttttgcttttctcaaaagcaaaagactcatccaacaagaacaaaaaaaaaaactaaagctcaatccaaaagacgaagaatgcattggatactacaacttctttttcacttttctttcaaatttacaattatgattttcacaatacagtttattcaaaaataaataaaaaaacgaggcatgaaaataatgattatcctcttcacttattaagccactcactataagcagagcaactccagaacatagtgagcccccaaaacattaaagcatgatgatgtctaatgatgatgatcttcttcgttccatttctctaaatttttgggatttctgcgaagacccttcttctctttctcttctctgaacttcaagattcgtgtcggacaaatttttgtttttatttttctgatgttaca

SEQ ID NO: 91 - DNA, 3000 bp, Arabidopsis thaliana
  misc_feature (1)..(3000): Ceres Promoter PR0924
atctataacgagttaacatgttgccagtttgaatcaagaagcttggatgatgaatgaatggatcggtttgtggtacaattcttaaaattgtagtagaggagacagagaaaaaacatgataagactttggtatttacaacttgacggagacaagacagtaagccaaatctgtcacaaaaacactcaaactcttttctcagtgttttgagtttaaagagagacttattcacttcccctttcgtaacacttatttgtctcccaaccaaacagtttctgtcctttcccttgtcctcccacgtgcatctttatatctcatgacttttcgtttctagatcttgaataatgtcttagtggattaggtttgttgtcggtaaattaggtgaccgtttttttcttatatttggaagatcgcgggatgaagcagatactgagtttcagggcatacacacctaatttgaaaatcattgttagtccaatttcactttaatcttgtttacaaaaaaattgatctgaaaatgttgatgggataagtaaaaatgtaagttttgctagtagtcatgatataataatagcaaaaccagatcaattttgagcaaaaggaagaaacaaaaaacagatcgatcccacgagcaagactaagtgtaaagtggttcccacaagagccatatggatatggtccttcaacttttaaagcccattacttcagtggtcgacccgacattacgccacgagtagtcacgcacgcacgactccgttcacgtgacattcacgttgatatttccccctctactctcttctgcttggttgatctaaaaaacatgaagagaccaacctaatttcatattaatatatgatatagacttcatactcaacagtcactttcgtaatccaaatccatatcttacgaaattagttcttaataaaggttgtggattaagttataatattgtgttaagagttaagacacagcatataaccttgtaccaacagtgctttattcttaaatggaaacaaaacatatgtcaatgtcaagcatacagctaaaatatcattatctaatattaagagtaaaacaagataattaaaaattgaaacaacaccatatttttatagctttacttatcgtatttttctagtcttcatggtaattgtgttgctttattttgtttataaatgaatttggttcgaccagatagtctaatatcagtttttaaacactggttttaataaaatcatatgtcggcaattcaacctgttacgttgtatgattgtatcctagtcaaataggggaggaggtactagtcgtttcaattagtttacgtaatcaatccaaagaaactataagctataaagatcctcaatttgttggttacaataaaaacaacagttgtcaaaatttatgtttataaaaagtaataactatgttccttcccatatagagcaaagtacctcaggataggcaaaccgtacttaatagcccttattcataatttgatccaactcttccccacaaaattgcaactgatgaagtcaatacttgtatagtgagtcaagctataaatgtctagtgatagttttgtctcttaaaaggttaacaaaagttatgacaagctgaaaaatcagagtttgctaggagtattacttacagttatcagtttaagtatcacatttatagtattgtatacaatgattcttaaattccaccttttccgtgcgaaaccaaattttctattggaaacatagaatgtaaacaaaaatatgggacgttgtccgttccaacattaaccaaacttgtctattactaatattcgtgttggtttgatgttggatgtctaaattcgttgaatcatgtgtctcttgacgaaatatgcatcttcttatttcttagtatagatgcactttatcattcttttagtacatgcttaatttttttttttaaaatatgttgattgtcatattgccaaaagtatgaattaaagacgcacatctaacacaagttagcagccgtaaatccttccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaa

SEQ ID NO: 92 - DNA, 1000 bp, Arabidopsis thaliana
  misc_feature (1)..(1000): Ceres Promoter YP0388
agaagtattcacgcaccaaggttatatttgtagtgacatattctacaattatcacatttttctcttatgtttcgtagtcgcagatggtcaattttttctataataatttgtccttgaacacaccaaactttagaaacgatgatatataccgtattgtcacgctcacaatgaaacaaacgcgatgaatcgtcatcaccagctaaaagcctaaaacaccatcttagttttcactcagataaaaagattatttgtttccaacctttctattgaattgattagcagtgatgacgtaattagtgatagtttatagtaaaacaaatggaagtggtaataaatttacacaacaaaatatggtaagaatctataaaataagaggttaagagatctcatgttatattaaatgattgaaagaaaaacaaactattggttgatttccatatgtaatagtaagttgtgatgaaagtgatgacgtaattagttgtatttatagtaaaacaaattaaaatggtaaggtaaatttccacaacaaaacttggtaaaaatcttaaaaaaaaaaaaagaggtttagagatcgcatgcgtgtcatcaaaggttctttttcactttaggtctgagtagtgttagactttgattggtgcacgtaagtgtttcgtatcgcgatttaggagaagtacgttttacacgtggacacaatcaacggtcaagatttcgtcgtccagatagaggagcgatacgtcacgccattcaacaatctcctcttcttcattccttcattttgattttgagttttgatctgcccgttcaaaagtctcggtcatctgcccgtaaatataaagatgattatatttatttatatcttctggtgaaagaagctaatataaagcttccatggctaatcttgtttaagcttctcttcttcttctctctcctgtgtctcgttcactagttttttttcgggggagagtgatggagtgtgtttgttgaatagttttgacgatca

SEQ ID NO: 93 - DNA, 283 bp, Arabidopsis thaliana
  misc_feature (1)..(283): Ceres Promoter PD0901
caaagtatttgacaagccatatggttttggatcaaaaagtcggtccaaaattaatgttttatgtgcaagaaccgacccattgtacacacgtgttaacatcttcaagactttcatctctatttttcttttggtcattaagatacccattgatccgaatctgttacattcccacctacttttttaatttttactatccactccaaattaaacacaaccgatgattttaataattggaagctttttaaaatatttctccacgtgcctctttgtgtttgtctatata

SEQ ID NO: 94 - DNA, 1000 bp, Arabidopsis thaliana
  misc_feature (1)..(1000): Ceres Promoter PT0623
aaagttattgacattttgaaaggaccgtaaatattaccaaaaaactgacggagttaggatcggccacgtagaaagggacaaagagagaacagtcacggactcggccagactaagtatgggcctgtctgaatccaaactcagctaagttccaaaagcataaagagagatgtgtaatgaaatgaacgtattctagaaacgaaagcaatgttatgctttgtttttgagccacatgtttttgggagatggagagaatcttttttacgtttttaacctaacccacttggcacttggccaaaaaagtgagaagaaactgtggcgaatgagtaggccacgccatggactttgttccttgtccttcaaaagttaaatttatgttatgcgtggggacaatctaagcaacgtggttcctttaaatatcgcagcttcctcttttacacttttggagcctacgtgttttgttttggaccggccaaatacacgagtcagtcagtttagaaataatttggatgtccaaaaatcttggagatccaaataaaataattagcatgttttagttcataagaatatgaaatgtagataaactgtctatattaatttttccatagaattggctttttatcgaggtgatgtacttaatgactttgttgattactactcgtataacaataaagaatatgatactatgtgagacttataatgaatttggtgtgtgttaattaatccagttgaaacagtttaataacaaatcagaataaaaattgtagtaagaaaatttgaacgctgatccttcaacctagatagtgaacctttcaaatactatatgattcacgtgtaatgtttttgaccgttggttatttttgtgtgaactatattaacttatcaatatcgaaaggctaaataagtaaataactaaaagaaagttcaggaaacaactcgacctaatgacctatcatttctgatcacccgtcctataaatacatacgtaagatcattcgttact

SEQ ID NO: 95 - DNA, 1662 bp, Arabidopsis thaliana
  misc_feature (1)..(1662): Ceres ANNOT ID no. 521911
  misc_feature (1)..(1662): Ceres GEMINI ID 5023A1
  misc_feature (1)..(1662): Ceres SEED LINE ME07663
aaacctgtattttatcaattaccacactttgtctaagcaaaatggatttattactcatatccttaaccactatcataatcgccgcctacatgcaaaatctacgacgtcggggatccaacataccgccgggaccaccaacgcgatttctggtcggaaaccttcatcaactgaaaccattatggacgcagtctttctccgagtggtcacagacttatggccccatcatatcggtgtggttaggatcacagctagctgttgtggtctcgagctctgacttagccaaacaagtgttgagagacaaagactaccaactctgtaaccgacacagaaccgcaaggatgactcagaacggcagcgatcttatttggtctgactacggagcacattatgtgaaaatgagaaaactctgtacactcgagctcttttctttgaaaagcatagagtgtttcaggtcgatgagagagatggaagtaagttccatggttaagtcgattttcaatgacttcatgagcgatgatcagaaaccagtggtgttgaggaactatctagattctgttgctttgaacattgtttcaagattagttatcgggaaaacattcgaacccaaagatggaagagagtttagatcaattgtagaaagggagactcgcttgcccggcgcaaccaagatgcttgattacaccgtttggcttaaacgtctttcgtcatggttcactagcgacaaggcgttcatgaagcacatggctcggaaaagaaattggtttaaacgagctgtaatggatgaagtatatggaggaagagatcaaaagtgttttgttcagagtctgttagagttgaaagagaaggatgagctgaccgaggagactgtgatgggactggtctggaacatgttaactgcaggagctgacacaaccgccataactattgaatgggcaatggcagagatgatcagatgcccgaccgtgaaagaaaaggtgcaggatgagcttgattccgtggttggatccggacggttaatgtctgatgcagatatcccaaaactgccgtttctgcaatgcgtactcaaagaagctctccggcttcaccctccaacaccattgatgcttccacacaaggccagcgaatcagttcaggtaggtgggtacaaagttcctaagggagccacggtttatgtcaacgtgcaggcgattgctcgagatcctgcaaactggagtaacccagatgagtttagaccagagaggtttcttgtggaggaaacggacgttaaaggtcaagactttcgggttcttccgtttgggtcgggaagacgggtgtgtccagccgctcaactcagcctcaatatgatgacattagcactaggtagtttgttgcattgtttctcatggacatcctctacacctcgagaacacattgacatgaccgagaagcctggattagtttgttacatgaaggctccattgcaggctctagcttcgtccaggctgccacaagagttatacctttaacttttaactgagatagattatattaatcaacataagataaagagagattctcaattgcgaaaaacagatgtagttatggcaagatttaggacatggatgatgacatggttcgtacaaacagaatgtagctattgatagtaaataaactaaatattcc

SEQ ID NO: 96 - protein, 349 aa, Arabidopsis thaliana
  misc_feature (1)..(349): Ceres ANNOT ID no. 521911
  misc_feature (1)..(349): Ceres GEMINI ID 5023A1
  misc_feature (1)..(349): Ceres SEED LINE ME07663
  misc_feature (120)..(330): Pfam Name: p450 Pfam Description: Cytochrome P450
MREMEVSSMVKSIFNDFMSDDQKPVVLRNYLDSVALNIVSRLVIGKTFEPKDGREFRSIVERETRLPGATKMLDYTVWLKRLSSWFTSDKAFMKHMARKRNWFKRAVMDEVYGGRDQKCFVQSLLELKEKDELTEETVMGLVWNMLTAGADTTAITIEWAMAEMIRCPTVKEKVQDELDSVVGSGRLMSDADIPKLPFLQCVLKEALRLHPPTPLMLPHKASESVQVGGYKVPKGATVYVNVQAIARDPANWSNPDEFRPERFLVEETDVKGQDFRVLPFGSGRRVCPAAQLSLNMMTLALGSLLHCFSWTSSTPREHIDMTEKPGLVCYMKAPLQALASSRLPQELYL

SEQ ID NO: 97 - DNA, 1819 bp, Arabidopsis thaliana
  misc_feature (1)..(1819): Ceres ANNOT ID no. 535161
  misc_feature (1)..(1819): Ceres GEMINI ID 5021H3
  misc_feature (1)..(1819): Ceres SEED LINE ME05326
aaaaaaaacactcaatatggagtcttctatatcacaaacactaagcaaactatcagatcccacgacgtctcttgtcatcgttgtctctcttttcatcttcatcagcttcatcacacggcggcgaaggcctccatatcctcccggtccacgaggttggcccatcataggcaacatgttaatgatggaccaactcacccaccgtggtttagccaatttagctaaaaagtatggcggattgtgccatctccgcatgggattcctccatatgtacgctgtctcatcacccgaggtggctcgacaagtccttcaagtccaagacagcgtcttctcgaaccggcctgcaactatagctataagctatctgacttacgaccgagcggacatggctttcgctcactacggaccgttttggagacagatgagaaaagtgtgtgtcatgaaggtgtttagccgtaaaagagctgagtcatgggcttcagttcgtgatgaagtggacaaaatggtccggtcggtctcttgtaacgttggtaagcctataaacgtcggggagcaaatttttgcactgacccgcaacataacttaccgggcagcgtttgggtcagcctgcgagaagggacaagacgagttcataagaatcttacaagagttctctaagctttttggagccttcaacgtagcggatttcataccatatttcgggtggatcgatccgcaagggataaacaagcggctcgtgaaggcccgtaatgatctagacggatttattgacgatattatcgatgaacatatgaagaagaaggagaatcaaaacgctgtggatgatggggatgttgtcgataccgatatggttgatgatcttcttgctttttacagtgaagaggccaaattagtcagtgagacagcggatcttcaaaattccatcaaacttacccgtgacaatatcaaagcaatcatcatggacgttatgtttggaggaacggaaacggtagcgtcggcgatagagtgggccttaacggagttattacggagccccgaggatctaaaacgggtccaacaagaactcgccgaagtcgttggacttgacagacgagttgaagaatccgacatcgagaagttgacttatctcaaatgcacactcaaagaaaccctaaggatgcacccaccgatccctctcctcctccacgaaaccgcggaggacactagtatcgacggtttcttcattcccaagaaatctcgtgtgatgatcaacgcgtttgccataggacgcgacccaacctcttggactgacccggacacgtttagaccatcgaggtttttggaaccgggcgtaccggatttcaaagggagcaatttcgagtttataccgttcgggtcgggtcgtagatcgtgcccgggtatgcaactagggttatacgcgcttgacttagccgtggctcatatattacattgcttcacgtggaaattacctgatgggatgaaaccaagtgagctcgacatgaatgatgtgtttggtctcacggctcctaaagccacgcggcttttcgccgtgccaaccacgcgcctcatctgtgctctttaagtttatggttcgagtcacgtggcagggggtttggtatggtgaaaactgaaaagtttgaagttgccctcatcgaggatttgtggatgtcatatgtatgtatgtgtatacacgtgtgttctgatgaaaacagatttggctctttgtttgccctttttttttttttctttaatggggattttccttgaatgaaatgtaacagtaaaaataagatttttttcaataagtaatttagcatgttgc

SEQ ID NO: 98 - protein, 520 aa, Arabidopsis thaliana
  misc_feature (1)..(520): Ceres ANNOT ID no. 535161
  misc_feature (1)..(520): Ceres GEMINI ID 5021H3
  misc_feature (1)..(520): Ceres SEED LINE ME05326
  misc_feature (41)..(509): Pfam Name: p450 Pfam Description: Cytochrome P450
  misc_feature (1)..(520): Bit score of 1239.7 for HMM based on sequences of FIGURE 1.
MESSISQTLSKLSDPTTSLVIVVSLFIFISFITRRRRPPYPPGPRGWPIIGNMLMMDQLTHRGLANLAKKYGGLCHLRMGFLHMYAVSSPEVARQVLQVQDSVFSNRPATIAISYLTYDRADMAFAHYGPFWRQMRKVCVMKVFSRKRAESWASVRDEVDKMVRSVSCNVGKPINVGEQIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSETADLQNSIKLTRDNIKAIIMDVMFGGTETVASAIEWALTELLRSPEDLKRVQQELAEVVGLDRRVEESDIEKLTYLKCTLKETLRMHPPIPLLLHETAEDTSIDGFFIPKKSRVMINAFAIGRDPTSWTDPDTFRPSRFLEPGVPDFKGSNFEFIPFGSGRRSCPGMQLGLYALDLAVAHILHCFTWKLPDGMKPSELDMNDVFGLTAPKATRLFAVPTTRLICAL

SEQ ID NO: 99 - protein, 520 aa, Arabidopsis thaliana
  misc_feature (1)..(520): Public GI no. 12578895
  misc_feature (1)..(520): Functional Homolog of  Ceres ANNOT ID no. 535161 at SEQ ID NO. 98
  misc_feature (41)..(509): Pfam Name: p450 Pfam Description: Cytochrome P450
  misc_feature (1)..(520): Bit score of 1239.8 for HMM based on sequences of FIGURE 1.
MESSISQTLSKLSDPTTALVIVVSLFIFISFITRRRRPPYPPGPRGWPIIGNMLMMDQLTHRGLANLAKKYGGLCHLRMGFLHMYAVSSPEVARQVLQVQDSVFSNRPATIAISYLTYDRADMAFAHYGPFWRQMRKVCVMKVFSRKRAESWASVRDEVDKMVRSVSCNVGKPINVGEQIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSETADLQNSIKLTRDNIKAIIMDVMFGGTETVASAIEWALTELLRSPEDLKRVQQELAEVVGLDRRVEESDIEKLTYLKCTLKETLRMHPPIPLLLHETAEDTSIDGFFIPKKSRVMINAFAIGRDPTSWTDPDTFRPSRFLEPGVPDFKGSNFEFIPFGSGRRSCPGMQLGLYALDLAVAHILHCFTWKLPDGMKPSELDMNDVFGLTAPKATRLFAVPTTRLICAL

SEQ ID NO: 100 - protein, 520 aa, Arabidopsis thaliana
  misc_feature (1)..(520): Public GI no. 12578911
  misc_feature (1)..(520): Functional Homolog of  Ceres ANNOT ID no. 535161 at SEQ ID NO. 98
  misc_feature (41)..(509): Pfam Name: p450 Pfam Description: Cytochrome P450
  misc_feature (1)..(520): Bit score of 1237.8 for HMM based on sequences of FIGURE 1.
MESSISQTLSKLSDPTTALVIVVSLFIFIGFITRRRRPPYPPGPRGWPIIGNMLMMDQLTHRGLANLAKKYGGLCHLRMGFLHMYAVSSPEVARQVLQVQDSVFSNRPATIAISYLTYDRADMAFAHYGPFWRQMRKVCVMKVFSRKRAESWASVRDEVDKMVRSVSCNVGKTINVGEQIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSETADLQNSIKLTRDNIKAIIMDVMFGGTETVASAIEWALTELLRSPEDLKRVQQELAEVVGLDRRVEESDIEKLTYLKCTLKETLRMHPPIPLLLHETAEDTSIDGFFIPKKSRVMINAFAIGRDPTSWTDPDTFRPSRFLEPGVPDFKGSNFEFIPFGSGRRSCPGMQLGLYALDLAVAHILHCFTWKLPDGMKPSELDMNDVFGLTAPKATRLFAVPTTRLICAL

SEQ ID NO: 101 - protein, 520 aa, Brassica napus
  misc_feature (1)..(520): Public GI no. 10197650
  misc_feature (1)..(520): Functional Homolog of  Ceres ANNOT ID no. 535161 at SEQ ID NO. 98
  misc_feature (41)..(511): Pfam Name: p450 Pfam Description: Cytochrome P450
  misc_feature (1)..(520): Bit score of 1240.4 for HMM based on sequences of FIGURE 1.
MESSISQTLSQVIDPTTGILIVVSLFIFIGLITRRRRPPYPPGPRGWPIIGNMSMMDQLTHRGLANLAKKYGGLCHLRMGFLHMYAVSSPDVAKQVLQVQDSVFSNRPATIAISYLTYDRADMAFAHYGPFWRQMRKVCVMKVFSRKRAESWASVRDEVDKMIRSVSSNVGKSINVGEQIFALTRNITYRAAFGSACEKGQDEFIRILQEFSKLFGAFNVADFIPYFGWIDPQGINKRLVKARNDLDGFIDDIIDEHMKKKENQNSVDAGDVVDTDMVDDLLAFYSEEAKLVSETADLQNSIKLTRDNIKAIIMDVMFGGTETVASAIEWALTELLRSPEDLNRVQQELAEVVGLDRRVEESDIEKLTFLKCTLKETLRLHPPIPLLLHETAEDTEIDGYFVPKKSRVMINAFAIGRDKNSWVDPETFRPSRFLEPGVPDFKGSNFEFIPFGSGRRSCPGMQLGLYALELAVAHILHCFTWKLPDGMKPSELDMSDVFGLTAPKATRLYAVPSTRLICSV

SEQ ID NO: 102 - protein, 520 aa, Brassica napus
  misc_feature (1)..(520): Public GI no. 10197652
  misc_feature (1)..(520): Functional Homolog of  Ceres ANNOT ID no. 535161 at SEQ ID NO. 98
  misc_feature (41)..(511): Pfam Name: p450 Pfam Description: Cytochrome P450
  misc_feature (1)..(520): Bit score of 1237.8 for HMM based on sequences of FIGURE 1.
MESSISQTLSQVLDPTTGILIVVSLFIFIGLITRRRRPPYPPGPRGWPIIGNMSMMDQLTHRGLANLAKKYGGLCHLRMGFLHMYAVSSPDVAKQVLQVQDSVFSNRPATIAISYLTYDRADMAFAHYGPFWRQMRKVCVMKVFSRKRAESWASVRDEVDKMIRSVSSNVGKSINVGEQIFALTRNITYRAAFGSACEKGQDEFIRILQEFSKLFGAFNVADFIPYFGWIDPQGINKRLVKARNDLDGFIDDIIDEHIKKKENQNSVDAGDVVDTDMVDDLLAFYSEEAKLVSETADLQNSIKLTRDNIKAIIMDVMFGGTETVASAIEWALTELLRSPEDLKRVQQELAEVVGLDRRVEESDIEKLTFLKCTLNETLRLHPPIPLLLHETAEDTEIDGYFVPKKSRVMINAFAIGRDKNSWVDPETFRPSRFLEPGVPDFKGSNFEFIPFGSGRRSCPGMQLGLYALELAVAHILHCFTWKLPDGMKPSELDMSDVFGLTAPKATRLYAVPCTRLICSV

SEQ ID NO: 103 - protein, 513 aa, Brassica napus
  misc_feature (1)..(513): Public GI no. 10197654
  misc_feature (1)..(513): Functional Homolog of  Ceres ANNOT ID no. 535161 at SEQ ID NO. 98
  misc_feature (34)..(502): Pfam Name: p450 Pfam Description: Cytochrome P450
  misc_feature (1)..(513): Bit score of 1205 for HMM based on sequences of FIGURE 1.
QTLSQLLDPTTAILIIVSLFIFIGLITRRRRSYPPGPRGWPIIGNMLMMDQLTHRGLANLAKKYGGLCHLRMGFLHMYAVSSPHVARQVLQVQDSIFSNRPATIAISYLTYDRADMAFAHYGPFWRQMRKVCVMKVFSRKRAESWASVRDEVDKMIRSVSSNVGKSINVGEQIFALTRNITYRAAFGSACEKGQDEFIRILQEFSKLFGAFNVADFIPYFGWIDPQGISKRLVKARNDLDGFIDDIIDEHMKKKENQNTVDDGDVGDTDMVDDLLAFYSEEAKLVSETTDLQNSIKLTRDNIKAIIMDVMFGGTETVASAIEWALTELLRSPEDLKRVQQELAEVVGLDRRVEESDIEKLTFLKCTLKETLRLHPPIPLLLHETAEDTEIDGYFVPKKSRVMINAFAIGRDPKSWPDAETFRPSRFLEPGVADFKGSNFEFIPFGSGRKSCPGMQLGLYALELAVAHILHCFTWKLPDGMKASELDMNDVFGLTAPKATRLFAVPSTRLICAV

SEQ ID NO: 104 - protein, 520 aa, Brassica napus
  misc_feature (1)..(520): Public GI no. 110432088
  misc_feature (1)..(520): Functional Homolog of  Ceres ANNOT ID no. 535161 at SEQ ID NO. 98
  misc_feature (41)..(511): Pfam Name: p450 Pfam Description: Cytochrome P450
  misc_feature (1)..(520): Bit score of 1240.4 for HMM based on sequences of FIGURE 1.
MESSISQTLSQVLDPTTGILIVVSPLIFVGLITRRRRPPYPPGPRGWPIIGNMSMMDQLTHRGLANLAKKYGGLCHLRMGFLHMYAVSSPDVAKQVLQVQDSVFSNRPATIAISYLTYDRADMAFAHYGPFWRQMRKVCVMKVFSRKRAESWASVRDEVDKMIRSVSSNVGKSINVGEQIFALTRNITYRAAFGSACEKGQDEFIRILQEFSKLFGAFNVADFIPYFGWVDPQGINKRLVKARNDLDGFIDDIIDEHIKKKENQNSVDAGDVVDTDMVDDLLAFYSEEAKLVSETADLQNSIKLTRDNIKAIIMDVMFGGTETVASAIEWALTELLRSPEDLKRVQQELAEVVGLDRRVEESDIEKLTFLKCTLNETLRLHPPIPLLLHETAEDTEIDGYFVPKKSRVMINAFAIGRDKNSWVDPETFRPSRFLEPGVPDFKGSNFEFIPFGSGRRSCPGMQLGLYALELAVAHILHCFTWKLPDGMKPSELDMSDVFGLTAPKATRLYAVPCTRLICAL

SEQ ID NO: 105 - protein, 514 aa, Camptotheca acuminata
  misc_feature (1)..(514): Public GI no. 47933890
  misc_feature (1)..(514): Functional Homolog of  Ceres ANNOT ID no. 535161 at SEQ ID NO. 98
  misc_feature (39)..(502): Pfam Name: p450 Pfam Description: Cytochrome P450
  misc_feature (1)..(514): Bit score of 1259.5 for HMM based on sequences of FIGURE 1.
MEMDALRQVLHPMPTALFFIAPLFFLFILSRLRRKLPYPPGPNGLPLVGNMMMMDQLTHRGLAKLAKQYGGIFHLRMGFLHMVAVSSPEIARQVLQVQDNIFSNRPATIAISYLTYDRADMAFAHYGPFWRQMRKLCVMKLFSRKRAESWESVRDEVDSMVRVVVSHTGKSVNIGELVFSLTRDIIYRAAFGSSSHEGQDEFIKILQEFSKLFGAFNIADFIPGLGWVDPQGLNARLVQARASLDGFIDSIIDDHIEKHRRRNVVDSDGDMVDDLLAFYSDEAKVTESDDLQNAIRLTRDNIKAIIMDVMFGGTETVASAIEWAMAELMKSPEDLKRVQQELAEVVGLDRRLEESDFDKLTYLKCALKETLRLHPPIPLLLHETAEDTEVAGYYIPARSRVMINAWAIGRDKNSWDEPETFKPSRFLKEGVPDFKGSNFEFIPFGSGRRSCPGMQLGLYALEMAVAHLLHCFTWTLPDGMKPSELDTDDVFGLTAPRATLFVAVPSPRLLCPLY

SEQ ID NO: 106 - protein, 520 aa, Glycine max
  misc_feature (1)..(520): Public GI no. 85001689
  misc_feature (1)..(520): Functional Homolog of  Ceres ANNOT ID no. 535161 at SEQ ID NO. 98
  misc_feature (41)..(510): Pfam Name: p450 Pfam Description: Cytochrome P450
  misc_feature (1)..(520): Bit score of 1258.2 for HMM based on sequences of FIGURE 1.
MDWQSMMGNLDPFQRTILILVPLTLLLLLLLSRTRPRPPYPPGPKGFPIIGNMFMMDQLTHRGLANLAKHYGGIFHLRMGFLHMVAISDPDAARQVLQVQDNIFSNRPATIAISYLTYDRADMAFAHYGPFWRQMRKLCVMKLFSRKRAESWQSVRDEVDAAVRAVASSVGKPVNIGELVFNLTKNIIYRAAFGSSSQEGQDEFIKILQEFSKLFGAFNIADFIPYLGCVDPQGLNSRLARARGALDSFIDKIIDEHVHKMKNDKSSEIVDGETDMVDELLAFYSEEAKLNNESDDLQNSIRLTKDNIKAIIMDVMFGGTETVASAIEWAMAELMRSPEDQKRVQQELADVVGLDRRAEESDFEKLTYLKCALKETLRLHPPIPLLLHETAEDATVGGYFVPRKARVMINAWAIGRDKNSWEEPETFKPARFLKPGVPDFKGSNFEFIPFGSGRRSCPGMVLGLYALELAVAHLLHCFTWELPDGMKPSEMDMGDVFGLTAPRSTRLIAVPTKRVVCPLF

SEQ ID NO: 107 - protein, 511 aa, Liquidambar styraciflua
  misc_feature (1)..(511): Public GI no. 5731998
  misc_feature (1)..(511): Functional Homolog of  Ceres ANNOT ID no. 535161 at SEQ ID NO. 98
  misc_feature (39)..(499): Pfam Name: p450 Pfam Description: Cytochrome P450
  misc_feature (1)..(511): Bit score of 1246 for HMM based on sequences of FIGURE 1.
MDSSLHEALQPLPMTLFFIIPLLLLLGLVSRLRQRLPYPPGPKGLPVIGNMLMMDQLTHRGLAKLAKQYGGLFHLKMGFLHMVAVSTPDMARQVLQVQDNIFSNRPATIAISYLTYDRADMAFAHYGPFWRQMRKLCVMKLFSRKRAESWESVRDEVDSAVRVVASNIGSTVNIGELVFALTKNITYRAAFGTISHEDQDEFVAILQEFSQLFGAFNIADFIPWLKWVPQGINVRLNKARGALDGFIDKIIDDHIQKGSKNSEEVDTDMVDDLLAFYGEEAKVSESDDLQNSIKLTKDNIKAIMDVMFGGTETVASAIEWAMTELMKSPEDLKKVQQELAVVVGLDRRVEEKDFEKLTYLKCVLKEVLRLHPPIPLLLHETAEDAEVGGYYIPAKSRVMINACAIGRDKNSWADPDTFRPSRFLKDGVPDFKGNNFEFIPFGSGRRSCPGMQLGLYALETTVAHLLHCFTWELPDGMKPSELEMNDVFGLTAPRAIRLTAVPSPRLLCPLY

SEQ ID NO: 108 - DNA, 1542 bp, Populus balsamifera subsp. trichocarpa
  misc_feature (1)..(1542): Ceres ANNOT ID no.1487764
atggattctcttctccaatctttgcaaactttacccatgtctttcttcttgatcattatctcttcaattttcttcttaggtctaatctctcgccttcgccggagatcaccatatccaccagggcctaaagggtttccacttattggtagcatgcatctgatggaccaattaactcaccgtggcttagctaaactagctaaacaatatggtgggctatttcatatgcgtatggggtacttgcatatggtagctgtttcatctcctgaagtagctcgccaagttttgcaagtccaggataacattttctccaatagaccagccaacatagccataagctacttaacctatgatcgtgccgatatggcctttgcccactatggtccgttctggcgccagatgcgtaagctctgcgtcatgaagctatttagccggaaaagggctgaatcatgggagtctgtgagagacgaggtggactcaatggttaagacagttgaatccaatataggcaagcctgtgaacgttggagaattgatatttacactgaccatgaatatcacttatagagcagcttttggggccaaaaatgaaggacaagatgagttcatcaagattttgcaggagttctccaagctttttggagcattcaacatttcggatttcattccttggcttggttggattgacccccaagggctcaccgctagacttgtcaaggctcgaaaagcacttgataaattcatcgaccatatcatcgatgatcatatccaaaaaagaaaacagaataactactctgaagaggctgaaaccgatatggttgatgacatgctaaccttttacagtgaagagacaaaagtaaacgaatcagatgatttacaaaacgccatcaaacttactagagacaacatcaaagccatcatcatggatgtgatgtttggtgggacggagacagtggcgtcggctatagagtgggccatggcagagctattgaagagtccagaagatataaaaagagtccagcaagagctcgccgacgtggttggtttagagcggcgcgtggaggaaagtgattttgataaactaacattcttcaaatgcacgcttaaagaaaccttaagacttcacccaccaatcccacttctcttacacgaaacatctgaagatgctgaggttgctggttattacgttccaaaaaagacaagggtcatgatcaatgcttatgctattggcagagacaagaattcatgggaagatcctgattcttttaagccttcgaggtttttggaaccaggggtgcctgatttcaaagggaatcacttcgaatttattccgttcgggtcaggtcggaggtcttgccctggcatgcaactggggttatacgcccttgatttggctgttgctcatttgcttcattgttttacttgggagttgcctgatggcatgaaaccaagtgaactcgacatgactgatatgtttggactcactgcgccaagagcaactcgactcgttgccgtcccgagaaagcgcgtggtctgtccactttaa

SEQ ID NO: 109 - protein, 513 aa, Populus balsamifera subsp. trichocarpa
  misc_feature (1)..(513): Ceres ANNOT ID no. 1487764
  misc_feature (1)..(513): Functional Homolog of  Ceres ANNOT ID no. 535161 at SEQ ID NO. 98
  misc_feature (39)..(502): Pfam Name: p450 Pfam Description: Cytochrome P450
  misc_feature (1)..(513): Bit score of 1243.3 for HMM based on sequences of FIGURE 1.
MDSLLQSLQTLPMSFFLIIISSIFFLGLISRLRRRSPYPPGPKGFPLIGSMHLMDQLTHRGLAKLAKQYGGLFHMRMGYLHMVAVSSPEVARQVLQVQDNIFSNRPANIAISYLTYDRADMAFAHYGPFWRQMRKLCVMKLFSRKRAESWESVRDEVDSMVKTVESNIGKPVNVGELIFTLTMNITYRAAFGAKNEGQDEFIKILQEFSKLFGAFNISDFIPWLGWIDPQGLTARLVKARKALDKFIDHIIDDHIQKRKQNNYSEEAETDMVDDMLTFYSEETKVNESDDLQNAIKLTRDNIKAIIMDVMFGGTETVASAIEWAMAELLKSPEDIKRVQQELADVVGLERRVEESDFDKLTFFKCTLKETLRLHPPIPLLLHETSEDAEVAGYYVPKKTRVMINAYAIGRDKNSWEDPDSFKPSRFLEPGVPDFKGNHFEFIPFGSGRRSCPGMQLGLYALDLAVAHLLHCFTWELPDGMKPSELDMTDMFGLTAPRATRLVAVPRKRVVCPL

SEQ ID NO: 110 - protein, 519 aa, Medicago sativa
  misc_feature (1)..(519): Public GI no. 77744233
  misc_feature (1)..(519): Functional Homolog of  Ceres ANNOT ID no. 535161 at SEQ ID NO. 98
  misc_feature (45)..(507): Pfam Name: p450 Pfam Description: Cytochrome P450
  misc_feature (1)..(519): Bit score of 1250.8 for HMM based on sequences of FIGURE 1.
MDSLLKFPIMVNLKEEPFLMAIMVIVPLTLLLGLMSRILKRPRYPPGPKGLPIIGNMLMMDQLTHRGLANLAKKYGGIFHLRMGFLHMVAISDADAARQVLQVQDNIFSNRPATVAIKYLTYDRADMAFAHYGPFWRQMRKLCVMKLFSRKHAESWQSVRDEVDYAVRTVSDNIGNPVNIGELVFNLTKNIIYRAAFGSSSREGQDEFIGILQEFSKLFGAFNISDFVPCFGAIDPQGLNARLVKARKDLDSFIDKIIDEHVEKKKSVVDEETDMVDELLAFYSEEAKLNNESDDLHNSIKLTKDNIKAIIMDVMFGGTETVASAIEWVMAELMKSPEDLKKVQQELAEVVGLSRQVEEPDFEKLTYLKCALKETLRLHPPIPLLLHETAEEATVNGYFIPKQARVMINAWAIGRDANCWDEPESFKPSRFLKPGVPDFKGSNFEFIPFGSGRRSCPGMQLGLYALDLAVAHLLHCFTWELPDGMKPSEMDMSDVFGLTAPRASRLIAIPTKRVLCPLD

SEQ ID NO: 111 - protein, 521 aa, Glycine max
  misc_feature (1)..(521): Ceres CLONE ID no. 1636607
  misc_feature (1)..(521): Functional Homolog of  Ceres ANNOT ID no. 535161 at SEQ ID NO. 98
  misc_feature (41)..(511): Pfam Name: p450 Pfam Description: Cytochrome P450
  misc_feature (1)..(521): Bit score of 1241.6 for HMM based on sequences of FIGURE 1.
  misc_feature (375)..(375): Xaa is any aa, unknown, or other
MDWQSMMGNLDPFQRTILILVPLTLLLLLLLSRTRPRPPYPPGPKGFPIIGNMFMMDQLTHRGLANLAKHYGGIFHLRMGFLHMVAISDPDAARQVLQVQDNIFSNRPATIAISYLTYDRADMAFAHYGPFWRQMRKLCVMKLFSRKRAESWQSVRDEVDSAVRAVANSVGKPVNIGELVFNLTKNIIYRAAFGSSSQEGQDDFIKILQEFSKLFGAFNIADFIPYLGRVDPQGLNSRLARARGALDSFIDKIIDEHVQKKNNYQSSEIGDGETDMVDELLAFYGEEAKLNNESDDNLQNSIRLTKDNIKAIIMDVMFGGTETVASAIEWVMSELMRSPEDQKRVQQELADVVGLDRRVEESDFEKLTYLKCALXETLRLHPPIPLLLHETAEDATVGGYFVPRKARVMINAWAIGRDKNSWEEPETFKPARFLKPGVPDFKGSNFEFIPFGSGRRSCPGMVLGLYALELAVAHLLHCFTWELPDGMKPSEMDMGDVFGLTAPRSTRLIAVPTKRVVCPLF

SEQ ID NO: 112 - DNA, 1542 bp, Populus balsamifera subsp. trichocarpa; identical to SEQ ID NO: 108
  misc_feature (1)..(1542): Ceres ANNOT ID no.6688937

SEQ ID NO: 113 - protein, 513 aa, Populus balsamifera subsp. trichocarpa
  misc_feature (1)..(513): Public GI no. 6688937
  misc_feature (1)..(513): Functional Homolog of  Ceres ANNOT ID no. 535161 at SEQ ID NO. 98
  misc_feature (39)..(502): Pfam Name: p450 Pfam Description: Cytochrome P450
  misc_feature (1)..(513): Bit score of 1230.5 for HMM based on sequences of FIGURE 1.
MDSLLQSLQTLPMSFFLIIISSIFFLGLISRLRRRSPYPPGPKGFPLIGSMHLMDQLTDRGLAKLAKQYGGLFHMRMGYLHMVAGSSPEVARQVLQVQDNMFSNRPANIAISYLTYDRADMAFAHYGPFWRQMRKLCVMKLFSRKRAESWESVRDEVDSMVKTVESNIGKPVNVGELIFTLTMNITYRAAFGAKNEGQDEFIKILQEFSKLFGAFNISDFIPWLGWIDPQGLTARLVKARKALDKFIDHIIDDHIQKRKQNNYSEEAETDMVDDMLTFYSEETKVNESDDLQNAIKLTRDNIKAIIMDVMFGGTETVASAIEWAMAELLKSPEDIKRVQQELADVVGLERRVEESDFDKLTFFKCTLKETLRLHPPIPLLLHETSEDAEVAGYYVPKKTRVMINAYAIGRDKNSWEDPDSFKPSRFLEPGVPDFKGNHFEFIPFGSGRRSCPGMQLGLYALDLAVAHLLHCFTWELPDGMKPSELDMTDMFGLTAPRATRLVAVPRKRVVCPL

SEQ ID NO: 114 - protein, 519 aa, Medicago sativa
  misc_feature (1)..(519): Public GI no. 77744235
  misc_feature (1)..(519): Functional Homolog of  Ceres ANNOT ID no. 535161 at SEQ ID NO. 98
  misc_feature (45)..(507): Pfam Name: p450 Pfam Description: Cytochrome P450
  misc_feature (1)..(519): Bit score of 1250.3 for HMM based on sequences of FIGURE 1.
MDSLLKYPIMENFKEEPFLMAIMFILPLILLLGLVSRILKRPRYPPGPKGLPVIGNMLMMDQLTHRGLANLAKKYGGIFHLRMGFLHMVAISDADAARQVLQVQDNIFSNRPATVAIKYLTYDRADMAFAHYGPFWRQMRKLCVMKLFSRKHAESWQSVRDEVDHAIRTVSDNIGNPVNIGELVFNLTKNIIYRAAFGSSSREGQDEFIGILQEFSKLFGAFNISDFVPCFGAIDPQGLNARLVKARKDLDSFIDKIIDEHVQKKKSVVDEETDMVDELLAFYSEEAKLNNESDDLHNSIKLTKDNIKAIIMDVMFGGTETVASAIEWAMAELMKSPEDLKKVQQELAEVVGLSRQVEEPDFEKLTYLKCALKETLRLHPPIPLLLHETAEEATVNGYFIPKQARVMINAWAIGRDANCWEEPESFKPSRFLKPGVPDFKGSNFEFIPFGSGRRSCPGMQLGLYALDLAVAHLLHCFTWELPDGMKPSEMDMSDVFGLTAPRASRLIAIPTKRVLCPLD

SEQ ID NO: 115 - DNA, 1545 bp, Populus balsamifera subsp. trichocarpa
  misc_feature (1)..(1545): Ceres ANNOT ID no.1457344
atggattctcttgtccaatctttgcaagcttcacccatgtctttcttcttgatcgctatcacttcacttttcttcttaggtctactctctcgccttcgccgaagattgccatatccaccagggcctaaagggttgccacttgtaggtagcatgcacatgatggaccaaataactcaccgtgggttagctaaactagctaagcaatatggtgggctatttcacatgcgtatggggtacttgcatatggtaactgtttcgtctcctgaaatagctcgccaagttttgcaagtccaggataacattttctccaacagaccagccaacatagccataaggtacttaacctatgatcgtgccgatatggcctttgcccactatggtcctttctggcgccagatgcgtaagctctgcgtcatgaagctatttagccggaaaagggctgaatcatgggagtctgtgagagatgaggtggactcaatgcttaagacagttgaagccaatataggcaagcctgtgaatcttggagaattgatttttacgttgaccatgaatatcacttacagagcagctttcggggctaaaaatgaaggacaggatgagttcatcaagattttgcaggagttctctaagctttttggagcattcaacatgtctgatttcattccctggctaggctggattgacccacaagggctcagcgctagacttgtcaaggctcgcaaggctcttgataaattcatcgactctatcatcgatgatcatatccaaaaaagaaaacagaataacttctctgaagatgctgaaaccgatatggtcgatgacatgctagccttttatagtgaagaagcaaggaaagtagatgaatcagatgatttacaaaaagccatcagccttactaaagacaacatcaaagccataatcatggatgtgatgtttggtgggacagagacggtggcgtcggcaatagagtgggtcatggcggagctaatgaagagtccagaggatcaaaaaagagtccagcaagagctcgcagacgtggtgggtttagagcggcgcgtggaggaaagtgatattgagaaactaacattcttgaaatgcgccctcaaagaaaccttaaggatgcacccaccaatcccacttctcctacatgaaacatccgaagatgctgaggttgctggttatttcattccaaagcaaacaagggtgatgatcaatgcttatgctattgggagagacaagaattcatgggaagatcctgatgcttttaagccttcaaggtttttgaaaccaggggtgcctgattttaaagggaatcacttcgaatttattcctttcgggtctggtcggaggtcttgccccggtatgcagcttgggttatacacacttgatttggctgttgctcacttgcttcattgttttacatgggaattgcctgatggcatgaaaccaagtgaacttgacatgactgatatgtttgggctcaccgcgccaagagcaactcgactcgttgccgttccgagcaagcgtgtgctatgccctctctaa

SEQ ID NO: 116 - protein, 514 aa, Populus balsamifera subsp. trichocarpa
  misc_feature (1)..(514): Ceres ANNOT ID no. 1457344
  misc_feature (1)..(514): Functional Homolog of  Ceres ANNOT ID no. 535161 at SEQ ID NO. 98
  misc_feature (39)..(503): Pfam Name: p450 Pfam Description: Cytochrome P450
  misc_feature (1)..(514): Bit score of 1223.7 for HMM based on sequences of FIGURE 1.
MDSLVQSLQASPMSFFLIAITSLFFLGLLSRLRRRLPYPPGPKGLPLVGSMHMMDQITHRGLAKLAKQYGGLFHMRMGYLHMVTVSSPEIARQVLQVQDNIFSNRPANIAIRYLTYDRADMAFAHYGPFWRQMRKLCVMKLFSRKRAESWESVRDEVDSMLKTVEANIGKPVNLGELIFTLTMNITYRAAFGAKNEGQDEFIKILQEFSKLFGAFNMSDFIPWLGWIDPQGLSARLVKARKALDKFIDSIIDDHIQKRKQNNFSEDAETDMVDDMLAFYSEEARKVDESDDLQKAISLTKDNIKAIIMDVMFGGTETVASAIEWVMAELMKSPEDQKRVQQELADVVGLERRVEESDIEKLTFLKCALKETLRMHPPIPLLLHETSEDAEVAGYFIPKQTRVMINAYAIGRDKNSWEDPDAFKPSRFLKPGVPDFKGNHFEFIPFGSGRRSCPGMQLGLYTLDLAVAHLLHCFTWELPDGMKPSELDMTDMFGLTAPRATRLVAVPSKRVLCPL

SEQ ID NO: 117 - protein, 519 aa, Centaurium erythraea
  misc_feature (1)..(519): Public GI no. 46403211
  misc_feature (1)..(519): Functional Homolog of  Ceres ANNOT ID no. 535161 at SEQ ID NO. 98
  misc_feature (42)..(507): Pfam Name: p450 Pfam Description: Cytochrome P450
  misc_feature (1)..(519): Bit score of 1247.5 for HMM based on sequences of FIGURE 1.
MDIRENQFLQALAADPLLILLLFITPLLFLFLLSRFRLKPYPPGPRGWPLIGNMTMMDQLTHRGLAKLAGKYGGILHLRMGFVHTVAVSSPDIARQVLQVQDNIFSNRPATIAISYLTYDRADMAFADYGPFWRQMRKLCVMKLFSRKRAESWDSVRDEVERMTHIVATNIGSPVNIGEMVFGLTKDVIYRAAFGTSSHEGQDEFIKILQEFSKLFGAFNLADFIPWLSWFDPQGLNKRLEKARASLDGFIDSIIDDHMNRKKIKSGSNDVVESDMVDELLVFFSDEAKVLESEDLQNSIKLTRDNIKAIIMDVMFGGTETVASAIEWAMAELMRNPDDLKRVQQELSDVVGLHRKVQESDFEKLTYFKCCLKETLRLHPPIPLLLHETAEASEIAGYRIPAKSRVMINAWAIGRDKDSWKDPDTFRPARFLEEGVPDFKGSNFEFIPFGSGRRSCPGMQLGLYALEVAVAHLLHCFTWELPDGMKPSELDMGDVFGLTAPRASRLVAVPSPRLLCPLY

SEQ ID NO: 118 - protein, 510 aa, Medicago truncatula
  misc_feature (1)..(510): Public GI no. 92888952
  misc_feature (1)..(510): Functional Homolog of  Ceres ANNOT ID no. 535161 at SEQ ID NO. 98
  misc_feature (36)..(499): Pfam Name: p450 Pfam Description: Cytochrome P450
  misc_feature (1)..(510): Bit score of 1201.2 for HMM based on sequences of FIGURE 1.
MDTLGQFQTTLLLVLPLTLFLLLNLASKFRKRAPYPPGPKGLPLIGNMNMLDKLTHRGLANLAKQYGGVYHLRMGFIHMVAISNAEAAREVLQLHDSIFSNRPATVAISYLTYNRADMAFAHYGPFWRQMRKLCVMKLFSRKRAESWQSVKDEVEVVITNVNNNLGKSVNVGELVFNLTKNIIYRAAFGSCSKEGQDEFISILQEFSKLFGAFNIADFVPCLKWVDPQGFNDRLVKARGALDGFIDKIFDEHVEKKRNMSGDEDSDMVDELLAFYSDEAKVENESDDLHNSIKLTRDNIKAIIMDVMFGGTETVASAMEWAMSELMRNPEELKRVQQELAVVVGLDRRVEESDIEKLTYLKCAVKETLRLHPPIPLLLHETAEDATVGGYFVPKGSRVMINVWAIGRDKDSWEDPEEFRPSRFLDSSAPDFKGSHFEFIPFGSGRRSCPGMQLGLYALDLALAHLLHCFTWELPNGMRASEMDTSDVFGLTAPRASRLIAVPAKRVVCPL

SEQ ID NO: 119 - protein, 514 aa, Broussonetia papyrifera
  misc_feature (1)..(514): Public GI no. 57470997
  misc_feature (1)..(514): Functional Homolog of  Ceres ANNOT ID no. 535161 at SEQ ID NO. 98
  misc_feature (43)..(503): Pfam Name: p450 Pfam Description: Cytochrome P450
  misc_feature (1)..(514): Bit score of 1234.9 for HMM based on sequences of FIGURE 1.
MDTKSITLLQEALKPLPMAIFLVIPLLFLLGHILRSRGRLPYPPGPKGLPIIGSMSMMDQLTHRGLAALAKQYGGIFHLKMGYLHMVAISSPETARQVLQLQDNIFSNRPANIAIRYLTYDRADMAFAHYGPFWRQMRKLCVMKLFSRKRAASWESVRGEVEKTVLSVAGSTGTAVNVGELVFKTTMDIIYRAAFGASNKEGQDEFISILQEFSKLFGAFNMADFIPWLTWVDPQGLNGRLKRARKALDAFIDKIIDEHVVKKNEAAETDMVDDLLAFYSNEEAKVNDAEDLHNAIRLTRDNIKAIIMDVMFGGTETVASAIEWAMTEMMRCPEDLKKVQQELADVVGLDRRLEESDFEKLTYLRCAIKETLRLHPPIPLLLHETAEDAAVAGYHIPKGSRVMINAWAIGRDKNSWADPDSFKPARFLRDGVPDFKGSNFEFIPFGSGRRSCPGMQLGLYALELTVGHLLHCFTWNLPDGMKPSELDMNDVFGLTAPRATRLVAIPTKRVVCTI

SEQ ID NO: 120 - protein, 521 aa, Lycopersicon esculentum x Lycopersicon peruvianum
  misc_feature (1)..(521): Public GI no. 5002354
  misc_feature (1)..(521): Functional Homolog of  Ceres ANNOT ID no. 535161 at SEQ ID NO. 98
  misc_feature (42)..(509): Pfam Name: p450 Pfam Description: Cytochrome P450
  misc_feature (1)..(521): Bit score of 1216.2 for HMM based on sequences of FIGURE 1.
MVLNNINSILEALQANPILIFFFIIPLFFLYLFSTSRRKRYPPGPLGWPLIGNMMIMDQLTHRGLAKLAQKYGGVFHLKMGYVHKIVISGPEEARQVLQVQDNIYSNRPKTVAISYLTYDRADMAFADYGPFWRQMRKLCVMKLFSRKRAESWDSVRDEVDSMVKIVTTNAGTSINLGELVFCLTRNIIYRAAFGTSSDEGQDDFIKILQEFSKLFGAFNMADFIPWLGWIGKQGLNVRLAKARASLDGFIDTIIDDHIERKKAIHVINDDGYRESDMVDELLAFYSEETKVNESEDLQNAIRLTRDNIKAIIMDVMFGGTETVASAIEWAMAELMKSPEDLKKVQQELANVVGLNRKVDESDFENLTYLKCCLKETLRLHPPIPLLLHETAEESTVSGYYIPANSHVIINSFAIGRDKNSWEDPDSFKPSRFLKEGVADFKGGNFEFLPFGSGRRSCPGMQLGLYALEMAVAHLLHCFTWELPDGMKPSELNMDDMFGLTAPLANRLVAVPTPRLLCEIY

SEQ ID NO: 121 - protein, 526 aa, Zea mays
  misc_feature (1)..(526): Ceres CLONE ID no. 1585325
  misc_feature (1)..(526): Functional Homolog of  Ceres ANNOT ID no. 535161 at SEQ ID NO. 98
  misc_feature (40)..(516): Pfam Name: p450 Pfam Description: Cytochrome P450
  misc_feature (1)..(526): Bit score of 1177.5 for HMM based on sequences of FIGURE 1.
MVTVAKIAMEWLQDPLSWVFLGTLALVVLQLRRRGKAPLPPGPKPLPIVGNMAMMDQLTHRGLAALAERYGGLLHLRLGRLHAFAVSTPDYAREVLQAQDGAFSNRPATIAIAYLTYDRADMAFAHYGPFWRQMRKLCVMKLFSRRRAETWVAVRDECAALVRAVASGGGGGGEAVNLGELIFNLTKNVTFRAAFGTRDGEDQEEFIAILQEFSKLFGAFNVVDFLPWLSWMDLQGINRRLRAARSALDRFIDKIIDEHVRRGKNPDDADADMVDDMLAFFAEAKPPKKGPAAAADGDDLHNTLRLTRDNIKAIIMDVMFGGTETVASAIEWAMAEMMHSPDDLRRLQQELADVVGLDRNVNESDLDKLPFLKCVIKETLRLHPPIPLLLHETAGDCVVGGYSVPRGSRVMVNVWAIGRHRASWKDADAFRPSRFTPEGEAAGLDFKGGCFEFLPFGSGRRSCPGTALGLYALELAVAQLAHGFNWSLPDGMKPSELDMGDVFGLTAPRATRLYAVPTPRLNCPLY

SEQ ID NO: 122 - protein, 531 aa, Zea mays
  misc_feature (1)..(531): Ceres CLONE ID no. 1600886
  misc_feature (1)..(531): Functional Homolog of  Ceres ANNOT ID no. 535161 at SEQ ID NO. 98
  misc_feature (42)..(521): Pfam Name: p450 Pfam Description: Cytochrome P450
  misc_feature (1)..(531): Bit score of 1148.6 for HMM based on sequences of FIGURE 1.
MAAVGKIGMEWLQDPLSWVFLGTVCLVVLQQLQRRRGKAPLPPGPQALPIVGNMGMMDQLTHRGLAALAETYGGLLHLRLGRLHAFAVSTPEYAREVLQAQDGAFSNRPATAAIAYLTYDRADMAFAHYGPFWRQMRKLCVMKLFSRRRAETWAAVRDECAALVRAVAVGGGGGRGEAVNLGELIFSLTKNVTFRAAFGTRDGEGQEEFIAILQEFSKLFGAFNVGDFLPWLGWMDLQGINRRLRAARSALDRFIDKIIDEHVRRGKSPDDADADMVDDMLAFFVEATPGKATGAAAADGGDDLHNTLRLTRDNIKAIIMDVMFGGTETVASAIEWAMAEMMHSPDDLRRVQQELADVVGLDRNVSESDLDRLPFLRCVIKETLRLHPPIPLLLHETADDCVVAGYSVPRGSRVMVNVWAIGRHRASWKDADAFRPSRFAPPEGEAAGLDFKGGCFEFLPFGSGRRSCPGMALGLYALELAVAQLAHAFNWSLPDGIKPSEMDMSDIFGLTAPRATRLYAVPTPRLNCPLY

SEQ ID NO: 123 - protein, 530 aa, Oryza sativa subsp. japonica
  misc_feature (1)..(530): Public GI no. 110289397
  misc_feature (1)..(530): Functional Homolog of  Ceres ANNOT ID no. 535161 at SEQ ID NO. 98
  misc_feature (40)..(520): Pfam Name: p450 Pfam Description: Cytochrome P450
  misc_feature (1)..(530): Bit score of 1149.7 for HMM based on sequences of FIGURE 1.
MADMVKFTMEWLQDPLSLAIVVTVAVLIMRMQRRRAAPFPPGPKPLPIVGNMAMMDQLTHRGLAALAKEYGGLMHLRLGRLHAFAVSTPEYAREVLQAQDGAFSNRPATTAIAYLTYDRADMAFAHYGPFWRQMRKLCVVKLFSRRRAETWLAVRDESAALVRAVAASRGEAAVNLGELIFNLTKNVIFRAAFGTRDGEGHDEFIAILQEFSKLFGAFNIGDFIPWLSWADTNGINARLVAARTALDRFIDKIIDEHMERGKNPDDADADMVDDMLAFLAEAKPHAGKAAAAAAGAGDGADDLQNTLRLTRDNIKAIIMDVMFGGTETVASAIEWAMAEMMHSPDDLRRVQEELAAVVGLGRDVAESDLDKLPFLRCVIKETLRLHPPIPILLHETAADCLVAGYSVPRGSRVMVNVWAIARDRAAWGPDADAFRPSRFAAGAAAEGLDFRGGCFEFLPFGSGRRSCPGMALGLYALELAVARLAHGFNWSLPDGMKPSELDMSDIFGLTAPRATRLSAVATPRLTCPLY

SEQ ID NO: 124 - protein, 532 aa, Triticum aestivum
  misc_feature (1)..(532): Ceres CLONE ID no. 758256
  misc_feature (1)..(532): Functional Homolog of  Ceres ANNOT ID no. 535161 at SEQ ID NO. 98
  misc_feature (40)..(511): Pfam Name: p450 Pfam Description: Cytochrome P450
  misc_feature (1)..(532): Bit score of 1114.6 for HMM based on sequences of FIGURE 1.
MVDLSMIDMEWLQEPLRWLFVASVIFVLLQRRRGKAPPLPPGPYSPPIVGNIFMMDQLTHRGFAGLAKQYGGLLHLRLGKVHTFAVSTPEYAQQVLQAQDAAFSHRPATIATTYLTYNRADMVFARYGPFWRQMRKLCVMKLFSRRRPGTWLAVRDESAALVRAVARRSGEPVNLGDLIFNLSMNVTFRAAFGAEAAGDGNGRKRDEFIAIMQEFSKLFGAFSIGDFIPWLGWADPQGISVRLRAARAALDEFIDKIIDEHIKRGKNPDDMDADMVDAMLAYLPEAKPEKAAGDDLQHTLRLNRDNIKAIIMDVMFGGTETVSSAIEWAMAEMMHSPDDLLQLQQEFADKVGLDRNVDEADLNNLSFLKCVIKETLRLHPPIPLLHRENAEDCVVGNYSVPQGSSVNINVFAMGRDDRVWKDADTFRPSRFMMGEGEAAGVDFKGGCFQFLPFGSGRRSCPGMALGLYSLELVIARLAHGFNWALPDGKKPSELDMGDIFGLTAPRATRLWVVPTPRLTCPLVVDVDAACQT

SEQ ID NO: 125 - DNA, 1680 bp, Arabidopsis thaliana
  misc_feature (1)..(1680): Ceres ANNOT ID no. 837136
  misc_feature (1)..(1680): Ceres GEMINI ID 5065F4
  misc_feature (1)..(1680): Ceres SEED LINE ME11531
atgagtcttcgtgtagtttcctccgttttctccggaatcaatcgaatccctaacctccacgagactcatactcttcttcgctctcatgtcttctctttcttcttcaaaccggcgaatatcggtagtatacggcgactggtcttatccccatcatatggagaccggagcagagatagtgttggctccgccgccgatgtttcgtcatctattctcgacgacgagcttctgagcagcgtatccgccgttagagatgccgatgaagcgctcgcgatgatttctgatcggttcgggtcaaatcgcggtggaatcgttgaacttgaagattgccgttcgattatctccgctgctgtcagtcgcggcaatgtggaccttgcgttgtcgatattctacaccatgcgagcgagtttcgatttaggtggaagtgacaatgatcgatggagttggtcaaggcctgatgttgaagtgtacacgatgttggttaatggtcttgctgcttccttaagggtttctgattctttaaggattatcagagatatttgccgtgttggtatctcccctgctgaggaggttccctttggtaaaattgtgagatgtccgagctgtttgattgccatagctgttgcacaaccacagcatggagttcagattgtatcttgcgctaattgccgttaccaatacgagcttttctctggtgacataactagcattgactcagaagagctcggcaaggacattcctctctgggaaaaagggctcagacttatccagataaagaagaacaaaatcacatcttcagtgcactctattgtggtacagactccttccggtacagcacgaacgcaccggtttgccactgagacagccgaactccctgcgcaagaaggagaaagagtgacaattgcatccgctgctccttctaatgtttacagacaagtgggacctttcaagtttatctccaaagctccaaacttttaccctggagaacctatgagcctcacaaaacacaaggatggacgagaatctatcttgctaaggcctcctagtaaagatggagataagatcttacaaccctcgtttctaataccccttcttgcaattttggctactggagatgctgcttctggtgttattgatcccagtttgcctcagttactctcagttgctactgttacatcactagcgataggagcaaccgtaaattcttttgtccttcctaagctaaatcagctccctgagcgaacagtagatgtggttggtatcaagcagcaacttttatctcaatatgatgtgctccagcgtcgcattagagatctaaaagaagcagttgagaaagaggtgtggatgttggctcgaatgtgccagctcgagaacaaaattttagcagtgggagagccagcttaccgtactcgaagaacaagagtaaagaaggtacgagaaagtctagagaactccataaagggaaagattgatctgatcgatagttatgctagaatatcttcaatgattgagattgaggtggaaatggacagtgatgttcttgcagccgaggcagtgaacaatactgaaaacattgctcaacagatagagcagatcatggaacttgaaaaccttgaagagaaatggaaaatacaggctgaagcaaacgacgaggccgaaagactacttagctcccaaccttaa

SEQ ID NO: 126 - protein, 559 aa, Arabidopsis thaliana
  misc_feature (1)..(559): Ceres ANNOT ID no. 837136
  misc_feature (1)..(559): Ceres GEMINI ID 5065F4
  misc_feature (1)..(559): Ceres SEED LINE ME11531
  misc_feature (1)..(559): Bit score of 1487.4 for HMM based on sequences of FIGURE 2.
MSLRVVSSVFSGINRIPNLHETHTLLRSHVFSFFFKPANIGSIRRLVLSPSYGDRSRDSVGSAADVSSSILDDELLSSVSAVRDADEALAMISDRFGSNRGGIVELEDCRSIISAAVSRGNVDLALSIFYTMRASFDLGGSDNDRWSWSRPDVEVYTMLVNGLAASLRVSDSLRIIRDICRVGISPAEEVPFGKIVRCPSCLIAIAVAQPQHGVQIVSCANCRYQYELFSGDITSIDSEELGKDIPLWEKGLRLIQIKKNKITSSVHSIVVQTPSGTARTHRFATETAELPAQEGERVTIASAAPSNVYRQVGPFKFISKAPNFYPGEPMSLTKHKDGRESILLRPPSKDGDKILQPSFLIPLLAILATGDAASGVIDPSLPQLLSVATVTSLAIGATVNSFVLPKLNQLPERTVDVVGIKQQLLSQYDVLQRRIRDLKEAVEKEVWMLARMCQLENKILAVGEPAYRTRRTRVKKVRESLENSIKGKIDLIDSYARISSMIEIEVEMDSDVLAAEAVNNTENIAQQIEQIMELENLEEKWKIQAEANDEAERLLSSQP

SEQ ID NO: 127 - protein, 547 aa, Arabidopsis thaliana
  misc_feature (1)..(547): Public GI no. 12323467
  misc_feature (1)..(547): Functional Homolog of  Ceres ANNOT ID no. 837136 at SEQ ID NO. 126
  misc_feature (1)..(547): Bit score of 1311.7 for HMM based on sequences of FIGURE 2.
MSLRVVSSVFSGINRIPNLHETHTLLRSHVFSFFFKPANIGSIRRLVLSPSYGDRSRDSVGSAADVSSSILDDELLSSVSAVRDADEALAMISDRFGSNRGGIVELEDCRSIISAAVSRGNVDLALSIFYTMRASFDLGTLISTLLLTQSGSDNDRWSWSRPDVEVYTMLVNGLAASLRVSDSLRIIRDICRVGISPAEEVPFGKIVRCPSCLIAIAVAQPQHGVQIVSCANCRYQYELFSGDITSIDSEELGSRGKVIQLMLGVRAVFVQTPSGTARTHRFATETAELPAQEGERVTIASAAPSNVYRQVGPFKFISKAPNFYPGEPMSLTKHKDGRESILLRPPSKDGDKILQPSFLIPLLAILATGDAASGVIDPSLPQLLSVATVTSLAIGATLPERTVDVVGIKQQLLSQYDVLQRRIRDLKEAVEKEVWMLARMCQLENKILAVGEPAYRTRRTRVKKVRESLENSIKGKIDLIDSYARISSMIEIEVEMDSDVLAAEAVNNTENIAQQIEQIMELENLEEKWKIQAEANDEAERLLSSQP

SEQ ID NO: 128 - DNA, 1839 bp, Populus balsamifera subsp. trichocarpa
  misc_feature (1)..(1839): Ceres ANNOT ID no.1491360
atgacaccaaacttaggcttttgctcctcctcctcctacctctcccgcttctcacactcccctcctctcctcactaaactctctccaaaaccaaactacactaccacagccactctcctctccctcttattttctttccataaaaccgcaccatttttttccacttcaagaacaccatccttaaaaccactcgcttcttcactaagccaatccgccgccgacgacgatgacaacgacaacaataactcttttttatcactaaatgaagactccctctccagagtctccgctgctaaagacgccaatgaagccctgcaaataatatctgtaatcactaataaaagtaacggtttagttagtgtaactgattgttgtggtattataactgccgccattgatcgcggcaatactgatttggctctctctgttttttacgctatgcgttccagcttcgatcaaggcgttactgagatagaaagatggaaatggtcgcggccggatgttagtgtttacacgtcattagttcaaggtcttgctgcggcattgaaggtttctgatgctcttaagatgattgattatatttgccgcgttggtgtgtcgcctagcgaggacgaggtgccatttggtatggttgtgagatgtccaacttgtatgatagctgttgctgttgcacaacctcaacatggcattcagattgcatcttgttccaagtgccggtaccaatacgagcttgtttctggggatatcactagtattgactcagaagcaatcagcatggatcttcctgcttgggaaagggggctaagatttttgcaactaatgaagcaaagtattcctgcagctgttcactccattgtggtacagaccccttctggtatggcaaggacacagagatttgctactgaaacagtagaccttccagcacaaaaaagtgaaagggtgaccattgcttcagcagttccatcaaatgtttacagaaatgtgggcccctttaaatttagtccaaaggctcccaatgtctaccctggagaaccaatgtgcctgacaaaccatgaaaatggccgggagtcactgttgttaagagcccctgtaaaagatggaaagccatccttgcttaacccttctgttcttgttccgctccttgctgtcttggttgctggagatgctgcatctggtattattgatcccagcttgccccaattccttgtagttgctgctatttcttctcttggtgttggagctactctaaatacactggttttccctggattgaaccagcttcctcaaaagtcagtggatgcaactgcaatcaagcagaagctgctgtctcagtatgacttacttcagtctcgcattaaggaactaaaagaagctgctgaaaaagaggtttggatgttggctcggatgtgtcagctggagaacaagatttttgctgtaggagaaccttcttatcgtgcccgtagaactagggtgaaaagggtccgagaaggcctggaaaattcactcgaaggacggatcgaactcattgatagctatgcaagaatttcttcgatgattgaaattgaggttgaaatggactctgatgttcttgctgcggaagcgttgagcaatgtggaaagcatagctgaacagatacagcaaatcatggagctggaaaatcttgaagagagatggagactacaagctgaagcaaatgacgaggctgaaagactacttagttctcaacctccaccaacctccagtttgcatagtgttgcattggtataccttatgcctctacttgagaagatctgctcggttgaatcatctaaaaagcaggcaggaaatacgcttgcgtga

SEQ ID NO: 129 - protein, 612 aa, Populus balsamifera subsp. trichocarpa
  misc_feature (1)..(612): Ceres ANNOT ID no. 1491360
  misc_feature (1)..(612): Functional Homolog of  Ceres ANNOT ID no. 837136 at SEQ ID NO. 126
  misc_feature (169)..(203): Pfam Name: PPR Pfam Description: PPR repeat
  misc_feature (1)..(612): Bit score of 1688.2 for HMM based on sequences of FIGURE 2.
MTPNLGFCSSSSYLSRFSHSPPLLTKLSPKPNYTTTATLLSLLFSFHKTAPFFSTSRTPSLKPLASSLSQSAADDDDNDNNNSFLSLNEDSLSRVSAAKDANEALQIISVITNKSNGLVSVTDCCGIITAAIDRGNTDLALSVFYAMRSSFDQGVTEIERWKWSRPDVSVYTSLVQGLAAALKVSDALKMIDYICRVGVSPSEDEVPFGMVVRCPTCMIAVAVAQPQHGIQIASCSKCRYQYELVSGDITSIDSEAISMDLPAWERGLRFLQLMKQSIPAAVHSIVVQTPSGMARTQRFATETVDLPAQKSERVTIASAVPSNVYRNVGPFKFSPKAPNVYPGEPMCLTNHENGRESLLLRAPVKDGKPSLLNPSVLVPLLAVLVAGDAASGIIDPSLPQFLVVAAISSLGVGATLNTLVFPGLNQLPQKSVDATAIKQKLLSQYDLLQSRIKELKEAAEKEVWMLARMCQLENKIFAVGEPSYRARRTRVKRVREGLENSLEGRIELIDSYARISSMIEIEVEMDSDVLAAEALSNVESIAEQIQQIMELENLEERWRLQAEANDEAERLLSSQPPPTSSLHSVALVYLMPLLEKICSVESSKKQAGNTLA

SEQ ID NO: 130 - protein, 565 aa, Oryza sativa subsp. japonica
  misc_feature (1)..(565): Public GI no. 50944321
  misc_feature (1)..(565): Functional Homolog of  Ceres ANNOT ID no. 837136 at SEQ ID NO. 126
  misc_feature (1)..(565): Bit score of 1497 for HMM based on sequences of FIGURE 2.
MALALLSPSSASAHRLPRPISSPPLGRAASATSIGSSFFPLCSSPPSSGSCSLRRASSAGGASEPEASGATSLDADLLRRVAGAADAGEALDIVAESAGGTGGLDASDCNAIVAAALDRGNVELALSVFEAMRSGFARAGAWRWARPDVRTYALLVQRLAAALRVSDALRIIDYVSRAGISSAEEVPFGMIIRCPSCMVAVAVAQPQHGTQTVSCSKCRYQYELFSGDIMSIESEEVSMDISALDKALRFINVIKDGLPAAVHSIVIRTPSGTARTHRFATQTVELPAQEGERVTISLAAPSNVYREMGPLKISARSQGFRPGEPMSLTNHINRQVSRLLRAPSKNEGPFVFNPYLLVGALALLASGDAASAFIDPSLPRFITATAFASAAVGTALNQVILPEIRKLPQKTVDIIAVRQQLLSQYDMLQTRLKDLKQLSEKEVWMLARMSQLENKILAVGEPSYRARRGRVKRVLESLESTLLAKIELMESYAKLCSMIEIEVEMDSDVIVAEAASSAERISEQIQQLMEIDSLEEQWRIQAEANDEAERLLNSDSSETFSAEHV

SEQ ID NO: 131 - DNA, 2034 bp, Panicum virgatum
  misc_feature (1)..(2034): Ceres CLONE ID no.1784441
aaagtttcctctcgtagtcatgtctgaaccacacgcacctcatccagagctggcgcacgccatgtgctcgacggtttgccgctgacacggcgcacggcgcgcgcgtccatggcgcttgctctcctcccgccctcgcccgcatcccaccgccgctcgcttcgtcccgtttcctctccgcttctcacgcgtgtcaccaccgccgccagcttcggccttgcgttttcttcccatccctcctccggctgctgctctctgcagaggactggcgccgcaggaggcgacggtgatggcgccggcgaggcctcatcggaagcgccggtggctggatggctcgacacggacctgctcaggcgggtctcaggcgcgggggatgcggaccaggcgctggacattgtcgcagactcggcgggaggttcgggcgccgctctggaagcgcccgaatgcaacgcgatcattgccgcggcacttgaccgaggcaacgtcgatctcgcgctctcggtgttcgaagccatgcgatccggcttcgcgggagtaggaggctggaggtgggcgagaccggacgatcggacatatgccttgctcgtacagcggttggcagccgccctgcgtgtttctaatgcaatcaggataatcgattatgcatcttgcgctggtgtttcttctacagaggaggttccttttgggattattgttcgctgtccaacctgcatggtagcagttgctgttgctcaaccgcaggatggaactcaggttgtttcctgttcaaagtgtcgatatcaatatgaattattttctggagacatttcaagcatcgaatctgaagaagttagcatggatatttcagctctggagaaggcattgagattcattaatataagaaaagatggtcttccagctgctgtccactctattgtgatccgagcaccttcaggaatagcgcgcactcatagatttgctacccagaatgtagaactccctgctcaagaaggagaaagagtaaccatttcgttggcagccccatccaatgtttatcgtgaaatgggtcccctcaagattgctgcacgctcacaaggatttaaaccaggcgagcctatgtgtctgactaatcacagcaatggacaagtctcaaagttgctaagagctccatcaatgaatgaaggatcatttttccttagcccatatttattggtcggtgctctttctttgcttgcctctggagatgctgcttccgcattcattgacccaagtcttcctagacttattacagcaactgcaattgcatcagctgccatcggaacaactctaaatcaagtggtcctgccagaaattcaaaagcttccacaaaaggcagtggatatagttgctgtacggcagcagcttttgtctcagtatgacattcttcagagccgtcttaaggaactgaaacagttggctcaaaaagaggtgtggatgctcacaaggatgtgtcaattggacaacaaaatactagcagtgggcgaaccatcttatcgtgctagacgaggtagagtaaagagggtacgggaaagcttggaaagcacactctctgcaaggattgagctaatggaaagttatgcaaaattgtgttcaatgattgaaattgaaattgagatggactctgatgttattgctgctgaagtggcaagcagtgcagagagaatatctgagcaaattcaacaattaatggagatcgacagccttgaagagcaatggcgtatacaagctgaagctaatgatgaagctgaaaggcttctgagttctgattcttcagaaacattgcctgctggacatatgtaatgtaattttggtaatgagcaagcattattctcctatttcctatttagatatttatatctctgcaattttaatgttctttaccaaattaaaaacaaatttctagtttaggattttgaaggaaaatactgttacagaacattaggaaaacgaaccataaaccctgcaacagaataatacagaatattgattggaaccgtgcaaaaaaaaaaaaaaaaaaaa

SEQ ID NO: 132 - protein, 568 aa, Panicum virgatum
  misc_feature (1)..(568): Ceres CLONE ID no. 1784441
  misc_feature (1)..(568): Functional Homolog of  Ceres ANNOT ID no. 837136 at SEQ ID NO. 126
  misc_feature (1)..(568): Bit score of 1511.5 for HMM based on sequences of FIGURE 2.
MALALLPPSPASHRRSLRPVSSPLLTRVTTAASFGLAFSSHPSSGCCSLQRTGAAGGDGDGAGEASSEAPVAGWLDTDLLRRVSGAGDADQALDIVADSAGGSGAALEAPECNAIIAAALDRGNVDLALSVFEAMRSGFAGVGGWRWARPDDRTYALLVQRLAAALRVSNAIRIIDYASCAGVSSTEEVPFGIIVRCPTCMVAVAVAQPQDGTQVVSCSKCRYQYELFSGDISSIESEEVSMDISALEKALRFINIRKDGLPAAVHSIVIRAPSGIARTHRFATQNVELPAQEGERVTISLAAPSNVYREMGPLKIAARSQGFKPGEPMCLTNHSNGQVSKLLRAPSMNEGSFFLSPYLLVGALSLLASGDAASAFIDPSLPRLITATAIASAAIGTTLNQVVLPEIQKLPQKAVDIVAVRQQLLSQYDILQSRLKELKQLAQKEVWMLTRMCQLDNKILAVGEPSYRARRGRVKRVRESLESTLSARIELMESYAKLCSMIEIEIEMDSDVIAAEVASSAERISEQIQQLMEIDSLEEQWRIQAEANDEAERLLSSDSSETLPAGHM

SEQ ID NO: 133 - DNA, 841 bp, Arabidopsis thaliana
  misc_feature (1)..(841): Ceres ANNOT ID no. 858797
  misc_feature (1)..(841): Ceres GEMINI ID 5127C3
  misc_feature (1)..(841): Ceres SEED LINE ME17216
agaagagagtcatgggaagatctccttgctgcgagaaagaacacatgaacaaaggtgcttggactaaagaagaagatgagagactagtctcttacatcaagtctcacggtgaaggttgttggcgatctcttcctagagccgctggtctccttcgctgcggtaaaagctgccgtcttcggtggattaactatctccgacctgatctcaaaagaggaaactttacacatgatgaagatgaacttatcatcaagcttcatagcctcctaggcaacaagtggtctttgattgcggcgagattacctggaagaacagataacgagatcaagaactactggaacacacatataaagaggaagcttttgagcaaagggattgatccagccactcatagagggatcaacgaggcaaaaatttctgatttgaagaaaacaaaggaccaaattgtaaaagatgtttcttttgtgacaaagtttgaggaaacagacaagtctggggaccagaagcaaaataagtatattcgaaatgggttagtttgcaaagaagagagagttgttgttgaagaaaaaataggcccagatttgaatcttgagcttaggatcagtccaccatggcaaaaccagagagaaatatctacttgcactgcgtcccgtttttacatggaaaacgacatggagtgtagtagtgaaactgtgaaatgtcaaacagagaatagtagcagcattagctattcttctattgatattagtagtagtaacgttggttatgacttcttgggtttgaagacaagaattttggattttcgaagcttggaaatgaaataaatgaatagtattagattctt

SEQ ID NO: 134 - protein, 269 aa, Arabidopsis thaliana
  misc_feature (1)..(269): Ceres ANNOT ID no. 858797
  misc_feature (1)..(269): Ceres GEMINI ID 5127C3
  misc_feature (1)..(269): Ceres SEED LINE ME17216
  misc_feature (67)..(112): Pfam Name: Myb_DNA-binding Pfam Description: Myb-like DNA-binding domain
  misc_feature (1)..(269): Bit score of 511.3 for HMM based on sequences of FIGURE 15.
MGRSPCCEKEHMNKGAWTKEEDERLVSYIKSHGEGCWRSLPRAAGLLRCGKSCRLRWINYLRPDLKRGNFTHDEDELIIKLHSLLGNKWSLIAARLPGRTDNEIKNYWNTHIKRKLLSKGIDPATHRGINEAKISDLKKTKDQIVKDVSFVTKFEETDKSGDQKQNKYIRNGLVCKEERVVVEEKIGPDLNLELRISPPWQNQREISTCTASRFYMENDMECSSETVKCQTENSSSISYSSIDISSSNVGYDFLGLKTRILDFRSLEMK

SEQ ID NO: 135 - DNA, 1851 bp, Arabidopsis thaliana
  misc_feature (1)..(1851): Ceres ANNOT ID no. 860676
  misc_feature (1)..(1851): Ceres GEMINI ID 5173B9
  misc_feature (1)..(1851): Ceres SEED LINE ME21595
agagagagactagtgagtgagagagtccatcgctttctttctttctctctctcgctctctcttcatctccaacagagacttctttctagagaaagagatcttcacaaatatgactgtgatgaatcaccgacacaagcaatgtcattttctcctcctccttctgatcactgtcttctctgccgcgttggatggtgtttcttccgagacagacgtcggagggtttgactacggtgaagcattgtctaaaagcttactctactttgaagctcagagatcaggaagacttccgtacaaccagcgcgtgacttggcgtgatcactctggtctcaccgatggtcttgaacaaggggttgatttagtgggaggatatcacgacgccggagaccatgttaaatttggacttccgatggcttttacggtgacaatgttgtcatggagtgtaatagagtacggtgactcactcgcttccaccggagagttatctcacgcgcttgaagccatcaagtggggaacagactacttcatcaaggcacacacaagcccaaatgtcttatgggccgaagttggcgacggtgacactgaccactactgttggcaaagaccggaggacatgacgacttcacggagagctttcaagatcgatgagaataatccgggatcagatatcgctggagaaactgcggcggctatggcggcagcttcgatcgttttccgttcaacaaatccacattactctcaccttctcttgcaccatgcccaacaattgtttgagtttggagacaagtacagaggaaaatacgatgagagtctaaaagttgtgaaaagttattatgcctcggtgagtgggtacatggacgagcttttatggggtgccacttggctttatcgagccaccgacaatgagcactatatgagttatgtggttgacatggctcaccaactaggtggcctttcttgggccatgtccgagtttagctgggacgtcaagttcgccggtgttcaactcctagcttccatgttgctaaaagaagaaaagcacaagcaacattctaaagtcctacaacaatacaaatcaaaggcggatcattacctatgctcaattctcaacaagaacatcaacggcacaaacgtccagcgaactcctgccggtttactctacgtccgacaatggaacaatatgcaatacgtatccacagcatctttcctcctaaccgtatattctgatcatctccgaaaatcaaacaccgatctcgagtgtcacgaaggaaccgtaactcctgacgagatgcttggctttgcgaaatctcaaatcgattacattttaggatcaaatccaatggaaacaagttatctagtcgggtacggtccaaaatacccgattagggttcatcatcgaggcgcgtctatcgcttcttttaaagagcacaaaggttttataggatgtactcaaggatatgataattggtatggacggtccgagccaaatccgagtgttttagtcggggctttggttggaggaccggatcaccaggatgattttgatgaccggaggggtaattacgttcaaacggaggcttgtacgtacaatactgctcctttggtcggtgtgtttgcgagacttatagagcttgaggagcaaaaacttgaagaagaagatgtgagcttggttgcaacttataagagatagtttttatttaatcaatacaaaaaaaagaaagaaaatgtggttttattttgcacccattttgccatttctatattgttagagtttttcttctcaactttttttttttgttttgtttttaaataaaaagtgtgtataaaatatcaattatcaatatagatttttgt

SEQ ID NO: 136 - protein, 525 aa, Arabidopsis thaliana
  misc_feature (1)..(525): Ceres ANNOT ID no. 860676
  misc_feature (1)..(525): Ceres GEMINI ID 5173B9
  misc_feature (1)..(525): Ceres SEED LINE ME21595
  misc_feature (39)..(502): Pfam Name: Glyco_hydro_9 Pfam Description: Glycosyl hydrolase family 9
  misc_feature (39)..(502): Pfam Name: Glyco_hydro_9 Pfam Description: Glycosyl hydrolase family 9
  misc_feature (1)..(525): Bit score of 1263.5 for HMM based on sequences of FIGURE 3.
MTVMNHRHKQCHFLLLLLITVFSAALDGVSSETDVGGFDYGEALSKSLLYFEAQRSGRLPYNQRVTWRDHSGLTDGLEQGVDLVGGYHDAGDHVKFGLPMAFTVTMLSWSVIEYGDSLASTGELSHALEAIKWGTDYFIKAHTSPNVLWAEVGDGDTDHYCWQRPEDMTTSRRAFKIDENNPGSDIAGETAAAMAAASIVFRSTNPHYSHLLLHHAQQLFEFGDKYRGKYDESLKVVKSYYASVSGYMDELLWGATWLYRATDNEHYMSYVVDMAHQLGGLSWAMSEFSWDVKFAGVQLLASMLLKEEKHKQHSKVLQQYKSKADHYLCSILNKNINGTNVQRTPAGLLYVRQWNNMQYVSTASFLLTVYSDHLRKSNTDLECHEGTVTPDEMLGFAKSQIDYILGSNPMETSYLVGYGPKYPIRVHHRGASIASFKEHKGFIGCTQGYDNWYGRSEPNPSVLVGALVGGPDHQDDFDDRRGNYVQTEACTYNTAPLVGVFARLIELEEQKLEEEDVSLVATYKR

SEQ ID NO: 137 - DNA, 675 bp, Gossypium hirsutum
  misc_feature (1)..(675): Ceres CLONE ID no.1948359
tgcttaaatcacgctattttttatgataaacaacaaaaagaaaaaaaaaagtaacctcacatggccatgaaaatcgctcactgagtcactgaactcgagccacattacataaaaaaacacaaatttcaaggcaaaaaaaagcaaaagggtgtgccaatatatagcttccaatagctatttcagctactaaatttccccctcacacctaaagagaagtggggacaatgggtgaacagagtaagctaagccttcgccattgttgcctcattctcttctctgttctcaccatttcctccacaacagcgtttgattatggcgatgcattaatgaagagcctcctttactttgaatcccaacgttccggtcggttaccgtacaatcaacgtgttacttggcgagaccattctggcctcaccgacggcttggaacaaggagtggatttagtcggaggatactacgacgccggcgatcacgtcaaatttggactcccgatggctttcacggtaacaatgttgtcttggagtgttatcgaataccgggaccagatcgccgatgccggtgaattagaacatgctttagaggcaattaaatgggggacagattacttcattaaagcacacaccagcccaaatgtactatgggcggaggtgggtgacggagacaccgaccattact

SEQ ID NO: 138 - protein, 477 aa, Gossypium hirsutum
  misc_feature (1)..(477): Ceres CLONE ID no. 1948359
  misc_feature (1)..(477): Functional Homolog of  Ceres ANNOT ID no. 860676 at SEQ ID NO. 136
  misc_feature (2)..(460): Pfam Name: Glyco_hydro_9 Pfam Description: Glycosyl hydrolase family 9
  misc_feature (2)..(460): Pfam Name: Glyco_hydro_9 Pfam Description: Glycosyl hydrolase family 9
  misc_feature (1)..(477): Bit score of 1212 for HMM based on sequences of FIGURE 3.
MKSLLYFESQRSGRLPYNQRVTWRDHSGLTDGLEQGVDLVGGYYDAGDHVKFGLPMAFTVTMLSWSVIEYRDQIADAGELEHALEAIKWGTDYFIKAHTSPNVLWAEVGDGDTDHYCWQRPEDMTTSRQAYKIDEKNPGSDLAGETAAAMAAASIVFKKTNPHYSHLLLHHAQELFEFGDKYRAKYDGSIGVVKSYYASVSGFMDELLWAALWLHEATDKEDYYLKYVINKAHCFGGIGWAISEFSWDVKYAGVQVLASMLLEKAKHEHEGHVLKQYRSKAEYYLCSCLNKNNATSDNVERTPGGLLYIRQWNNMQYVSTATFLLTVYSDFLRNSNQHLRCPTGTIDPEEILSFAKSQVDYILGSNPMNMSYLVGYGSKYPIRVHHRGASIVSYRENKGFIGCTQGYDNWYSRVEPNPNVLVGALVGGPDCRDNFMDQRDNYMQTEACTYNTAPLVGVFARLLQLEENLEVELVASY

SEQ ID NO: 139 - DNA, 1581 bp, Populus balsamifera subsp. trichocarpa
  misc_feature (1)..(1581): Ceres ANNOT ID no.1472020
atggagaaaaagcagcagcaccaatgttatggagcagctccaaaacccaccttcagatttgcaaaacagtgggctgttctcttgatctctatcttccccatcttgaatacaggtcttgctgttgattacggtgatgccttaaaaaagagccttctttacttcgaatcacaacgttccggtcgcttaccctacaaccagagagtaacatggcgtcaccattctggactcactgatggcttggaacaaggggtggatttggtcggaggatattatgatgcaggggaccatgtaaaatttggactgccaatggccttcaccgtgacaatgctttcatggactgtaatagaattccaacatcagattgccgttgccggagaattggaacacgcattagaagcaatcaaatggggaactgattatttcatcaaggcacatactagcccgaatgtgctatgggcagaggtgggtgacggtgacaccgaccactattgctggcaacggccggaggacatgaccacatcacggcaagcttacaggatcgacgagaataatcccgggtcagatcttgctggagaaaccgcggcggcaatggcggcggcatcaatagtgttcaagaaaacaaaccctcattactctcacctgctcttgcaccatgcccaacagttgtttgagtttggagacaagtatagaggtaaatatgatgaaaatatgggtgtggtgaaaagctactatgcgtcggtgagtggatacaaagacgaattgctatggggagctctgtggctgtacaaggccaccgacaatgaaaagtatctcgagtacgtcattaacaatgctcattgttttggcgggactggttgggccatggaagaattcagctgggatgtgaagtatgctggccttcaaattatggctgcaaagttgctcgtggaagaaaagcacagggaacatggcgacacgttggaacaataccgatcaaaagccgagcactacctatgctcatgccttaacaaaaacaacggtaccaatgtgaatcgtaccccaggtggtctattgcacatccggcaatggaacaacatgcagtatgtctcaacggcagcattccttctcactgtatactccgatttccttctaaactcgaatcaaaagctcaaatgccatggtggatctgtggatcacgaagagatcctcggttttgctaaatctcaggttgattacatcctaggttcaaacccaatgaacatgagttatttagtgggatacggccctaaataccccgcaagagtgcaccatagaggggcctcaattgtgtcatacagagagaacaaggggttcattgggtgcacccaagggtacgacaattggtatggccgggaggagcctaacccaaatgttttagtcggagcattggtcggaggacctgattgtcaggataacttcacggaccagagaagcaattacatgcagactgaggcctgcacatacaatacagcaccactagttggagtttttgccaagttattacaaatggagggccaaaagagccatgataatcacaatcagcctttggtagcttcctattaa

SEQ ID NO: 140 - protein, 526 aa, Populus balsamifera subsp. trichocarpa
  misc_feature (1)..(526): Ceres ANNOT ID no. 1472020
  misc_feature (1)..(526): Functional Homolog of  Ceres ANNOT ID no. 860676 at SEQ ID NO. 136
  misc_feature (42)..(504): Pfam Name: Glyco_hydro_9 Pfam Description: Glycosyl hydrolase family 9
  misc_feature (42)..(504): Pfam Name: Glyco_hydro_9 Pfam Description: Glycosyl hydrolase family 9
  misc_feature (1)..(526): Bit score of 1273.6 for HMM based on sequences of FIGURE 3.
MEKKQQHQCYGAAPKPTFRFAKQWAVLLISIFPILNTGLAVDYGDALKKSLLYFESQRSGRLPYNQRVTWRHHSGLTDGLEQGVDLVGGYYDAGDHVKFGLPMAFTVTMLSWTVIEFQHQIAVAGELEHALEAIKWGTDYFIKAHTSPNVLWAEVGDGDTDHYCWQRPEDMTTSRQAYRIDENNPGSDLAGETAAAMAAASIVFKKTNPHYSHLLLHHAQQLFEFGDKYRGKYDENMGVVKSYYASVSGYKDELLWGALWLYKATDNEKYLEYVINNAHCFGGTGWAMEEFSWDVKYAGLQIMAAKLLVEEKHREHGDTLEQYRSKAEHYLCSCLNKNNGTNVNRTPGGLLHIRQWNNMQYVSTAAFLLTVYSDFLLNSNQKLKCHGGSVDHEEILGFAKSQVDYILGSNPMNMSYLVGYGPKYPARVHHRGASIVSYRENKGFIGCTQGYDNWYGREEPNPNVLVGALVGGPDCQDNFTDQRSNYMQTEACTYNTAPLVGVFAKLLQMEGQKSHDNHNQPLVASY

SEQ ID NO: 141 - DNA, 1690 bp, Gossypium hirsutum
  misc_feature (1)..(1690): Ceres CLONE ID no.1924069
acttcactcctaaaagtaaacacactaaataagtagccaaacaaaatggttggtttaggagggaaggaggggacaatggagaagaagatgatggtgaagaagcagctaaacaacaatcatcaaaatacccccagatttgcctcccattcgacccttcttctcttctccgctgctgttttcgccattctcacaacaacggcagcagctcaaccatttgattatgccgatgcattagccaagagcctcctttactttgaatcccaacgatccggtcgtttaccctacaaccaacgcgtcacttggcgcgacaattctggcctcaccgacggattggaacaaggagtggacttagtggggggatattacgatgctggggatcacgtcaagtttggactcccaatggcttttacagtcacaatgttgtcttggggtatcatcgaattccacgacgaaattgccattgccggggaattggagcatgctttagaggctattaaatgggggacggattacttcatcaaggcacacaccagccccaatgtactatgggcagaggtgggtgatggggacactgaccattactgttggcaacgccccgaggatatgaccacctcgcgccaagcttacaagatcgaccagagcaatcccggatcggatctggccggagagacggcggcggcaatggcggccgcctcgattgtgttcaagaaaacaaacccacattactctctcttactcttgcaccatgcccaagagttgtttgagttcggggataagtacaggaggaaatatgacggaagtgttgcggtggtgaaaaactactatgcgtcggtgagcggatacatggatgagttgctgtgggcagctttgtggctttacgaggccaccgacaaggaggagtatttgaaatacgttgtaaacaatgctgatgcttttggtgggattggctgggccattacggagttcagttgggatgttaagtacgctggagttcaaattatggcctcaaagttgctggagaaggaaaaacacaagcagcacgctcacattctgaagcaataccgatcaaaagccgagtactacctatgctcatgtctcaacaaaaacaacgacaccaccaccaacattgaccgaaccccaggaggccttttatacatccggcaatggaacaacatgcaatacgtgacgacggcagcattccttctcaccatctactcagaattcctccaagattcgaaccaaaacctccattgtcccgccggaacagtggatcatgaagagatcctcagttttgccaaatctcaagttgattacgtactaggttcaaatcccatgaacatgagttatttagtgggttatggatcaaaataccccaccaaggtgcaccatagagggtcctcaatcgtgtcatacagggagaataaagggttcattgggtgcactcaaggttatgaccattggtataatcgagccgaagtgaatcctaatgtgttggttggggcagtggtcgggggacctgattccgaagataatttttgggaccaaagagataattacatgcaaaccgaggcttgcacgtataatacagctccattagttggagttttggccaaattgttacagttagaggaaaaccatgaactagaattgtttgcctcttattagaagcaaatataaatatcaagtgagc

SEQ ID NO: 142 - protein, 539 aa, Gossypium hirsutum
  misc_feature (1)..(539): Ceres CLONE ID no. 1924069
  misc_feature (1)..(539): Functional Homolog of  Ceres ANNOT ID no. 860676 at SEQ ID NO. 136
  misc_feature (58)..(522): Pfam Name: Glyco_hydro_9 Pfam Description: Glycosyl hydrolase family 9
  misc_feature (58)..(522): Pfam Name: Glyco_hydro_9 Pfam Description: Glycosyl hydrolase family 9
  misc_feature (1)..(539): Bit score of 1274.1 for HMM based on sequences of FIGURE 3.
MVGLGGKEGTMEKKMMVKKQLNNNHQNTPRFASHSTLLLFSAAVFAILTTTAAAQPFDYADALAKSLLYFESQRSGRLPYNQRVTWRDNSGLTDGLEQGVDLVGGYYDAGDHVKFGLPMAFTVTMLSWGIIEFHDEIAIAGELEHALEAIKWGTDYFIKAHTSPNVLWAEVGDGDTDHYCWQRPEDMTTSRQAYKIDQSNPGSDLAGETAAAMAAASIVFKKTNPHYSLLLLHHAQELFEFGDKYRRKYDGSVAVVKNYYASVSGYMDELLWAALWLYEATDKEEYLKYVVNNADAFGGIGWAITEFSWDVKYAGVQIMASKLLEKEKHKQHAHILKQYRSKAEYYLCSCLNKNNDTTTNIDRTPGGLLYIRQWNNMQYVTTAAFLLTIYSEFLQDSNQNLHCPAGTVDHEEILSFAKSQVDYVLGSNPMNMSYLVGYGSKYPTKVHHRGSSIVSYRENKGFIGCTQGYDHWYNRAEVNPNVLVGAVVGGPDSEDNFWDQRDNYMQTEACTYNTAPLVGVLAKLLQLEENHELELFASY

SEQ ID NO: 143 - protein, 543 aa, Zea mays
  misc_feature (1)..(543): Ceres CLONE ID no. 350091
  misc_feature (1)..(543): Functional Homolog of  Ceres ANNOT ID no. 860676 at SEQ ID NO. 136
  misc_feature (44)..(513): Pfam Name: Glyco_hydro_9 Pfam Description: Glycosyl hydrolase family 9
  misc_feature (44)..(513): Pfam Name: Glyco_hydro_9 Pfam Description: Glycosyl hydrolase family 9
  misc_feature (1)..(543): Bit score of 1262.8 for HMM based on sequences of FIGURE 3.
MRAGAEARGDSPRAMSAAATPRHRLGVALLLLLLLGGADAKAHSYEDALRKSLLYFEAQRSGRLPHSQRVTWRHHSGLTDGLEQGVDLVGGYYDAGDHVKFGLPMAFTVTMLSWSLIEYGADVAAAGELGHALEAVKWGTDYFVKAHTRPDELWAEVGDGDTDHYCWQRPEDMTTSRQAYKVDRDHPGSDVAGETAAAMAAASIVFRDSNPHYAHLLLHHAQQLFEFADKYRGKYDSSIAEVKSYYASVSGYKDELLWAALWLHRATGRADYLDYVVDNADSFGGTGWAINEFSWDVKYAGVQILAARLLLRGEHATRHRSTLERYRAKAERYVCACLGRNTEGGADANVERSPGGMLYVRQWNNMQYVTSAAFLLSAYSDYLAEAGVRTVSCAGGETVAAREVAALARAQVDYVLGTNPRGVSYLVGYGPKYPSRVHHRAASIVPYKHSKEFIGCTQGFDHWFGRRSSNPNVLVGAIVGGPDRRDRFRDNRENYMQTEACTYNTAPMVGMFAKLHRLARQEREQGPTPAPAPAPVTSAAADV

SEQ ID NO: 144 - DNA, 1440 bp, Panicum virgatum
  misc_feature (1)..(1440): Ceres CLONE ID no.1791482
ggacagcccaccacactccactctcccctcccctcccctcccctcccctcccggccccgactcccaccgcccaacaaccgacgggtgccgccgccgctacctgctacgtacgcgcacgtaccaccaacctgcgcgtacccgccgattgatcggacggccagcgtgcgccgctccgccgagccaccgacgtcgtcgtacgcacgggacggcggcggccatccgtcccgggcgccgccggccgggacacgccaacaagttctgcctactgggcacagcagcagcagcagcagcgtcggcagcaacattttagaggcgcggcgatgaggatcacggggagcggcgccgccactgctactgcggcggcggcggaggcggccggcctgtggctccggcccggccggctcggggaggttctcgccgtcgcgctcttcttcgcgtcggcggcgctgtccctggcgggcgccgagtcgccgccgccggcggccgggccggcgtcggcgtcggcgcggcacgactacgaggacgcgctgcgcaagagcctgctctacttcgaggcgcagcggtcggggcggctgccgcacggccagcgcgtggcgtggcgcgaccactccggcctcaccgacggcctcgagcaaggggtggatttggtgggcgggtactacgacgccggcgaccacgtcaagttcggcctgcccatggccttcaccgtcaccatgctctcctggagcctcctcgagtacggcgccgacgtcgccgacgccggcgagctcgcccacgcgctcgagtccatcaagtggggcaccgactacttcatcaaggcgcacacccagcccgacgagctctgggcagaggtgggcgacggcgacacggaccactactgctggcagcggccggaggacatgacgacgtcgcggcaggcgtacaaggtcgaccgcgagcgcccggggtcggacgtcgccggcgagaccgccgccgccatggccgccgcctccatggtgttccgggagcacaacccgcactacgccagcctcctcctgcaccacgccctgcagctgttcgagttcgccgacaagtaccggggcaagtacgacagcagcatcgcggaggtgaagagctactacgcctccgtcagcggctaccacgacgagctcctctgggcggcgctctggctccaccgcgccaccggccgcgccgagttcctcgactacgccgtcgacaacgcccacgccttcggcggcaccggctgggccatcaccgagttcagctgggacgtcaagtacgccggcgtccagatcctcgccgccaggctgctgctgagcggggagcacgcgccgcgccaccgggagacgctggagcggtaccgggccaaggcggagcactacgtgtgcgcgtgcctgggccggaacgctgccggcggcgccgacgccaacgtggagcgga

SEQ ID NO: 145 - protein, 554 aa, Panicum virgatum
  misc_feature (1)..(554): Ceres CLONE ID no. 1791482
  misc_feature (1)..(554): Functional Homolog of  Ceres ANNOT ID no. 860676 at SEQ ID NO. 136
  misc_feature (65)..(533): Pfam Name: Glyco_hydro_9 Pfam Description: Glycosyl hydrolase family 9
  misc_feature (65)..(533): Pfam Name: Glyco_hydro_9 Pfam Description: Glycosyl hydrolase family 9
  misc_feature (1)..(554): Bit score of 1258.8 for HMM based on sequences of FIGURE 3.
MRITGSGAATATAAAAEAAGLWLRPGRLGEVLAVALFFASAALSLAGAESPPPAAGPASASARHDYEDALRKSLLYFEAQRSGRLPHGQRVAWRDHSGLTDGLEQGVDLVGGYYDAGDHVKFGLPMAFTVTMLSWSLLEYGADVADAGELAHALESIKWGTDYFIKAHTQPDELWAEVGDGDTDHYCWQRPEDMTTSRQAYKVDRERPGSDVAGETAAAMAAASMVFREHNPHYASLLLHHALQLFEFADKYRGKYDSSIAEVKSYYASVSGYHDELLWAALWLHRATGRAEFLDYAVDNAHAFGGTGWAITEFSWDVKYAGVQILAARLLLSGEHAPRHRETLERYRAKAEHYVCACLGRNAAGGADANVERSPGGMLYVRQWNNMQYVTSAAFLLSAYSGYLSSAGEAVACAGGGAASAGEVFAMARSQVDYVLGSNPRGMSYLVGYGARFPARVHHRAASIVPYKHSKEFIGCAQGFDDWFVRRGANPNVVVGAIVGGPDRRDRFRDHRENYMQTEACTYNTAPMVGMFAMLNRLARDEAVAAAADPSVNR

SEQ ID NO: 146 - protein, 531 aa, Oryza sativa subsp. japonica
  misc_feature (1)..(531): Public GI no. 50912563
  misc_feature (1)..(531): Functional Homolog of  Ceres ANNOT ID no. 860676 at SEQ ID NO. 136
  misc_feature (36)..(505): Pfam Name: Glyco_hydro_9 Pfam Description: Glycosyl hydrolase family 9
  misc_feature (36)..(505): Pfam Name: Glyco_hydro_9 Pfam Description: Glycosyl hydrolase family 9
  misc_feature (1)..(531): Bit score of 1281.6 for HMM based on sequences of FIGURE 3.
MRGRALVLVAALLLQLLLLAAAGGAGAAATERKAHNYEDALRKSLLYFEAQRSGRLPHNQRVAWRDHSGLTDGLEQGVDLVGGYYDAGDHVKFGLPMAFTVTMLSWSMIEYGDDVEAAGELGHALEAIKWGTDYFIKAHTKPNELWAEVGDGDTDHYCWQRPEDMTTSRQAYKVDRERPGSDVAGETAAAMAAASIVFRKSNPHYASLLLHHAQQLFEFADKYRGKYDSSIAEVKSYYASVSGYKDELLWAALWLHRATGKAHYLDYVVDNADCFGGTGWAITEFSWDVKYAGVQILAARLLLRGEHEERHRSTLEQYRAKAEHYVCGCLGRNADGGADANVERSPGGMLYVRQWNNMQYVTNAAFLLAAYADYLGDDADGAVSCAGGETAGAGEVAALARAQVDYVLGTNPRGISYLVGYGAKYPNRVHHRAASIVPYKHSKEFIGCTQGFDHWFGRRSSNPNVLVGAIVGGPDRRDRFRDNRENYMQTEACTYNTAPMVGMFAKLNRMARQEREQEEVAAPARSTAADV

SEQ ID NO: 147 - protein, 536 aa, Triticum aestivum
  misc_feature (1)..(536): Ceres CLONE ID no. 917285
  misc_feature (1)..(536): Functional Homolog of  Ceres ANNOT ID no. 860676 at SEQ ID NO. 136
  misc_feature (44)..(509): Pfam Name: Glyco_hydro_9 Pfam Description: Glycosyl hydrolase family 9
  misc_feature (44)..(509): Pfam Name: Glyco_hydro_9 Pfam Description: Glycosyl hydrolase family 9
  misc_feature (1)..(536): Bit score of 1241.1 for HMM based on sequences of FIGURE 3.
MSRGRVRRAAGSPVAAAAAAALVLLQAAALALSLGCDAAAAEPDYREALSKSLLYFEAQRSGRLPYNQRVRWRGHSGITDGLQQGVDLVGGYYDAGDHVKFGLPMAFTVTMLSWGAIEFGDDIAAAGEWQHTLEAIKWGTDYFIKAHTEPFVYWAEVGDGDTDHYCWQRPEDMTTSRKAYRVDKDNPGSDLVAETAAALAAAAIVFRASNPHYSHILLHHAQQLFEFGDRYRGNYYGSIAEVRSFYASVSGYRDELLWAAFWLHRATGKEEFLRYAVDKADCFGGVGWAMTEFSWDVKYAGLQVLASKLLLDGDPQGERHRVVLEQYKAKAEHYLCACLRLNNGSNVDRSPGGMLYVRQWNNLQYASSAAFLLTVYSRYLAGAGARLRCPDAPAVPPSELLALARSQADYILGRNPLRLSYMVGYGPRFPAQVHHRAASIVSHKANNRFIGCMQGFDHWYASKRPNPNVLTGAIVGGPNCRDEFRDDRANYVQTEACTYNTAPMVAVFARLHNLSAAEEEEGCRPGTALGLSANCR

SEQ ID NO: 148 - DNA, 1257 bp, Arabidopsis thaliana
  misc_feature (1)..(1257): Ceres ANNOT ID no. 860791
  misc_feature (1)..(1257): Ceres GEMINI ID 5154A4
  misc_feature (1)..(1257): Ceres SEED LINE ME18822
aaggaagaagaaaaatcgagaaccatcttctcagccgattttagtaaccatcttcttgtttgctccgaacaatcaagagatcgaaaatggctgatgttcacaaaggaaaggtttgtgtaaccggtgccggagggtttttgggttcgtgggtcgtcgatcttcttctctctaaggattacttcgtccatggcactgtcagagaccctgataatgaaaagtatgctcatttgaagaagctcgagaaagctggtgacaaactcaagctcttcaaggctgatttgttggactacggctctcttcaatctgctattgcaggttgcagcggagtcttccatgtcgcttgcccggttccaccagcttcagtccctaatcctgaggtagaattgatcgcacctgctgtggatggcacgctgaatgtgcttaaggcatgcattgaagcgaatgttaagcgtgttgtgtatgtttcctctgtagctgcggctttcatgaaccctatgtggtcaaagaatcaagtattagatgaggcatgttggtctgaccaggaatactgcaagaaaactgagaattggtattgtctggcaaagacacgagcagagagtgaagcttttgaatttgcaaaacgaaccggacttcatctcgtcagtgtttgccctacccttgttttgggacctatactgcagcagaacacagtaaatgctagtagcctggttcttcttaagcttcttaaagagggttttgaaacacgtgataaccaagaacgtcatttggtagatgtgcgtgatgtagctcaagctttactcttggtttatgagaaagcagaagctgaaggaagatacatatgtacatcccacacggttaaagaagagattgtggttgagaagctgaagagtttttatccacattacaactacccaaagaaatacattgatgcggaagatagagtgaaggtgagttcagagaaattgcagaagttgggttggacttaccggccgttggaggaaacacttgtggattctgttgagagctaccggaaagctaagcttgtggactgaaaacttggaaagaagagcaaaatagtgttttagcttcatatgttatagttatagtgttccattctgcacacacacacacactctctcatcgtttactcaataataagagttgtgcattcaccatggatttctgagtttttgttattttctttttagatatcattacttttattaccaatctacaattttctttccataatatttt

SEQ ID NO: 149 - protein, 321 aa, Arabidopsis thaliana
  misc_feature (1)..(321): Ceres ANNOT ID no. 860791
  misc_feature (1)..(321): Ceres GEMINI ID 5154A4
  misc_feature (1)..(321): Ceres SEED LINE ME18822
  misc_feature (9)..(133): Pfam Name: Epimerase Pfam Description: NAD dependent epimerase/dehydratase family
  misc_feature (1)..(321): Bit score of 764 for HMM based on sequences of FIGURE 4.
MADVHKGKVCVTGAGGFLGSWVVDLLLSKDYFVHGTVRDPDNEKYAHLKKLEKAGDKLKLFKADLLDYGSLQSAIAGCSGVFHVACPVPPASVPNPEVELIAPAVDGTLNVLKACIEANVKRVVYVSSVAAAFMNPMWSKNQVLDEACWSDQEYCKKTENWYCLAKTRAESEAFEFAKRTGLHLVSVCPTLVLGPILQQNTVNASSLVLLKLLKEGFETRDNQERHLVDVRDVAQALLLVYEKAEAEGRYICTSHTVKEEIVVEKLKSFYPHYNYPKKYIDAEDRVKVSSEKLQKLGWTYRPLEETLVDSVESYRKAKLVD

SEQ ID NO: 150 - protein, 321 aa, Arabidopsis thaliana
  misc_feature (1)..(321): Public GI no. 15226135
  misc_feature (1)..(321): Functional Homolog of  Ceres ANNOT ID no. 860791 at SEQ ID NO. 149
  misc_feature (9)..(254): Pfam Name: Epimerase Pfam Description: NAD dependent epimerase/dehydratase family
  misc_feature (1)..(321): Bit score of 709 for HMM based on sequences of FIGURE 4.
MAVVQKGKVCVTGAGGFLGSWVVNHLLSRDYFVHGTVRDPGNEKYAHLKKLDKAGDKLKLFKADLLNYGSLQSAIAGCSGVFHVACPVPSASVPNPEVDLIAPAVDGTLNVLKACVEAKVKRVVYVSSVSAVAMNPMWSKSQVLDETAWSDQDYCKKTENWYSLSKTRAESEAFEFAKRTGLDLVSVCPTLVLGPVLQQHTVNASSLVLLKLLKEGYESRNNQERHLVDVRDVAQALLLVYEKAEAEGRYICIGHTVREQEVAEKLKSLYLNYNYPKRYIEADGKVKVSSEKLQKLGWTYRPLEETLVDSVESYRKAKLVD

SEQ ID NO: 151 - DNA, 736 bp, Gossypium hirsutum
  misc_feature (1)..(736): Ceres CLONE ID no.1930079
  misc_feature (655)..(655): n is a, c, t, g, unknown, or other
  misc_feature (656)..(656): n is a, c, t, g, unknown, or other
aatgaacttcggaaaaacaagcatcgcattgagtcagagaagtgactatcgtgtgacgagtgaaaacagctgactcatctacatacttcaaaattaatacatacgcgaagtccagaatgttattttagagataaacataaaccaatattgtgagagaaaatatggctcaggccactggaaaagtgtgtgtgacaggagccggcggctaccttggctcttgggttgtcaagcatcttctctccaacaactacacagtccacggcaccgttagacaacctggggatgccaaatatgcccatttgaatcaacttgagagagcatctcacaacctccaactcttcaaggctgatgttctggattacgattctctttgttccgccattacaggctgcaccggtgtcttccatgttgcctctcccgttccctccaccatcgttcctaatccccaggaggaagtgattgaaccggctgtaaagggcacacttactgtgctcaaagcatgtgttgaatccaatgttaaacgagttgttgttgtgtcttctgtgactgctgtttccttgaaccctaggtggccggtgggtcagatcaaggatgaggcttgctggtctgacaaggaatactgcgcagcaacaaagaattggtattgcctttcaannacagaagcagagagtgaggcttttgagtttgcaaaaaagtctggacttgacgttgttactgtttgtcctactctcatatg

SEQ ID NO: 152 - protein, 319 aa, Gossypium hirsutum
  misc_feature (1)..(319): Ceres CLONE ID no. 1930079
  misc_feature (1)..(319): Functional Homolog of  Ceres ANNOT ID no. 860791 at SEQ ID NO. 149
  misc_feature (8)..(131): Pfam Name: Epimerase Pfam Description: NAD dependent epimerase/dehydratase family
  misc_feature (1)..(319): Bit score of 411.7 for HMM based on sequences of FIGURE 4.
MAQATGKVCVTGAGGYLGSWVVKHLLSNNYTVHGTVRQPGDAKYAHLNQLERASHNLQLFKADVLDYDSLCSAITGCTGVFHVASPVPSTIVPNPQEEVIEPAVKGTLTVLKACVESNVKRVVVVSSVTAVSLNPRWPVGQIKDEACWSDKEYCAATKNWYCLSKTEAESEAFEFAKKSGLDVVTVCPTLIWGPLLQSTINASSKVLINLLKEGYDTLEIKLRKIVDVRDVAQALLLVYEKPAAEGRYICTAHTIKARDLVDKLRSMFPQYNYPKSFTAGGEEDTVSSEKLQRLGWSYRPLEETLVDSIESYKKAGILD

SEQ ID NO: 153 - protein, 321 aa, Glycine max
  misc_feature (1)..(321): Ceres CLONE ID no. 477792
  misc_feature (1)..(321): Functional Homolog of  Ceres ANNOT ID no. 860791 at SEQ ID NO. 149
  misc_feature (6)..(194): Pfam Name: Epimerase Pfam Description: NAD dependent epimerase/dehydratase family
  misc_feature (1)..(321): Bit score of 754.3 for HMM based on sequences of FIGURE 4.
MAAKKVCVTGAGGFVASWLVKLLLSKGYIVHGTVRDPEPATQKYEHLLKLHGASENLTLFKADLLNYESLRSAISGCTAVFHLACPVPSISVPNPQVEMIEPAVKGTTNVLEASLEAKVQRLVFVSSLAAISNSPNLPKDKVIDESYWSDKDYCKTTQNWYCFSKTEAEEQALDFAKRTGLDVVSICPSLVLGPILQSTTVNASSLALLKLLKGVNSMENKIRWIVDVRDVADAILLAYEKLEAEGRYICHSHTIKTRDMLEKLKSIYPNYKYPAKYTEVDDYISFSSEKLQRLGWKYRSLEETLVDSVESYREAGHLQSE

SEQ ID NO: 154 - protein, 323 aa, Triticum aestivum
  misc_feature (1)..(323): Ceres CLONE ID no. 677424
  misc_feature (1)..(323): Functional Homolog of  Ceres ANNOT ID no. 860791 at SEQ ID NO. 149
  misc_feature (11)..(255): Pfam Name: Epimerase Pfam Description: NAD dependent epimerase/dehydratase family
  misc_feature (1)..(323): Bit score of 775.3 for HMM based on sequences of FIGURE 4.
MAAAAAARKSVCVTGAGGFVASWLVKLLLSKGHYAVRGTVRDPGNAKNAHLKALEGAGERLELLSADLLNYDSIASAVAGCEGVFHVASPVPSGRSTNPEEEVIAPAVTGTLNVLKACYEAKVKRVVMVSSVAAVSNNPNWPKDKLFDEDSWSDEDLCRKGEDWYFLSKTLAEREAFAYAAKTGLDIVTICPSLVIGPLMQSTVNTSSNILLNYLKGERDTVENKLRNVVDVRDVADALLLAYENPEASGRYICSSKPVKVSDMISVLKTLYPMYTYPKNFTEVEENTIYSSEKLQKLGWTFRPLEKTLGDSVESYKASGVLN

SEQ ID NO: 155 - protein, 321 aa, Oryza sativa subsp. japonica
  misc_feature (1)..(321): Public GI no. 51091033
  misc_feature (1)..(321): Functional Homolog of  Ceres ANNOT ID no. 860791 at SEQ ID NO. 149
  misc_feature (11)..(134): Pfam Name: Epimerase Pfam Description: NAD dependent epimerase/dehydratase family
  misc_feature (1)..(321): Bit score of 756 for HMM based on sequences of FIGURE 4.
MLGGDGRTKTVCVTGAGGFVASWLVKLLLSRGCYTVHGTVRDPGDAKNAHLMSLDGAAERLRLFKADLLDYGSVAAAIAGCDDVFHVACPVLLSAPNPEVDILAPAVTGTTNVLKACSEAKVGRVVVVSSVSAAMVNPNWSEGKAIDEDCWSDVDYCRATKNWYTLGKTLAEIEAFDYAKRSGLDLVTLCPSLVIGPLLQPTVNASSTVILGCLKGDCEVKIKLRNFVDVRDVADALLLLYETPGVSGRYICSSHARRMPHIIDLLKSWYPGYKFADKFVEVSDEPQFNSGKLEKLGWKIKPFEETLRDSVESYRAAGVLD

SEQ ID NO: 156 - protein, 319 aa, Zea mays
  misc_feature (1)..(319): Ceres CLONE ID no. 336720
  misc_feature (1)..(319): Functional Homolog of  Ceres ANNOT ID no. 860791 at SEQ ID NO. 149
  misc_feature (8)..(200): Pfam Name: Epimerase Pfam Description: NAD dependent epimerase/dehydratase family
  misc_feature (1)..(319): Bit score of 755.1 for HMM based on sequences of FIGURE 4.
MDPVRKSVCVTGAGGFVASELVKLLLSRGQYAVRGTVRDPGASKNAHLKVLEGAEERLQLLKADLMDYDSIASAVAGCEGVFHVASPVLSHRPSNPEVEVIAPAVIGTTNVLKACYEAKVRRVVVVSSCGAVYANPIYPKGKVFDEDCWSDEDYCRKKEDWYLVSKTLSEREALAFAAKTGLDVVTVCPSLVFGPLMQPTVNLSSEMILKYFKDLETVENVLSNMVDIRDVADALLLTYEKPEASGRYICSSHAIKISDMINILKTMYPSYPYPKNFVEDDVNSVYSSEKLQKLGWSFKPIEESLRDTVESYKAFGILN

SEQ ID NO: 157 - DNA, 1337 bp, Panicum virgatum
  misc_feature (1)..(1337): Ceres CLONE ID no.1790816
aggaagagctgcccagctgtggaggagactcggaggaggcctcgtcaacgccatggccgggagttcgacggtgtgcgtgaccggcgccggcgggttcatcgcctcgtggctcgtcaagctcctcctctcccgcggctacaccgtccacggcaccgtccgcgacctgggtgacaagaagtcagcccatctgaagcggctcgagtatgccgctgaaagcctcaggattttcaaggccgatctcctggactacgacgcgatggctgctgccattgtgggatgccagggggttttccatgtggccactcctgtgccatcagagaagctgactgatctagagctgcaaatgctggctccggctgttactggcaccacgaatgtgctcagggctgcctcggccgcgggtgtccagcgagtggtggtcgtgtcatccatagtggccgtggagatcaacccgaaagattggcctgaaggcaagatcagagacgagagctgctggtcagacgaggagttctgcaggaacaataacatctggtacccggtcgccaagatcatctcggaagaggcggcgctggagtacgggcgtcagaccgggctcgacgtggtgtccgtcaatccggggttggtgttcgggcccatgctgcagccgacggttaacgcgagcagccagttcctcatctacttactgaaaggaggccctgacaaggtgaggaacaagctctggcacatcgtcgacgtccgcgaccttgccgaggcgctgctcttggtctacgagggtgctggagcctccggtaggcacatctgcgcacctcatgtcgtcagcgtccgcgaactcctcgactcgctgaagagcaactaccctgattacccttgcattgccaaggagagcgtatttgacagagatcacccggctccgatgagttctgagaagctgaagaagctcgggtggagcttccggccgctggaggagacgatcgccgacgcgatcgggttctgccagcgcgctgggttccttggtgatgcggatggggcggctccctgccgtttccctcctcttttcaaccaaatctagtcttggaaatcgcatggatcaatcgttcagaaaaaaaaagaaatcgcatggatctgggggcaacgcagccaagcgtgcaaatgtttatgcttttctgtatctctcgtgtggtaccaacttagatttgtgaactgttttggttgtaatctggtgatgctactgtgcatgcgcttatcaggtcagcagaatggttatcaggtctgtaattctttcctatgaataaaagggaagtattgtactcttcgtctaaaaaaaaaaaaaaaaaaaa

SEQ ID NO: 158 - protein, 338 aa, Panicum virgatum
  misc_feature (1)..(338): Ceres CLONE ID no. 1790816
  misc_feature (1)..(338): Functional Homolog of  Ceres ANNOT ID no. 860791 at SEQ ID NO. 149
  misc_feature (7)..(194): Pfam Name: Epimerase Pfam Description: NAD dependent epimerase/dehydratase family
  misc_feature (1)..(338): Bit score of 722.8 for HMM based on sequences of FIGURE 4.
MAGSSTVCVTGAGGFIASWLVKLLLSRGYTVHGTVRDLGDKKSAHLKRLEYAAESLRIFKADLLDYDAMAAAIVGCQGVFHVATPVPSEKLTDLELQMLAPAVTGTTNVLRAASAAGVQRVVVVSSIVAVEINPKDWPEGKIRDESCWSDEEFCRNNNIWYPVAKIISEEAALEYGRQTGLDVVSVNPGLVFGPMLQPTVNASSQFLIYLLKGGPDKVRNKLWHIVDVRDLAEALLLVYEGAGASGRHICAPHVVSVRELLDSLKSNYPDYPCIAKESVFDRDHPAPMSSEKLKKLGWSFRPLEETIADAIGFCQRAGFLGDADGAAPCRFPPLFNQI

SEQ ID NO: 159 - DNA, 1561 bp, Arabidopsis thaliana
  misc_feature (1)..(1561): Ceres ANNOT ID no. 863641
  misc_feature (1)..(1561): Ceres GEMINI ID 5170H8
  misc_feature (1)..(1561): Ceres SEED LINE ME18779
attctcacaaatctctcttccacccattgttatctctgtagaagcgtgagagagatcacgcgtgttcaccgacacaatcaaaatatggcgaacggagccgatagattggatctggacggtaaaccgattaagccgatgacgatatgcatgatcggtgccggaggtttcattggctctcatctctgtgagaagcttatgacggagactcctcacaaggttcttgcgcttgatgtttacaatgataagatcaagcacttgcttgagcctgataccgttcaatgggctggtcggatccagtttcatcgtatcaacattaagcatgattctagacttgaaggactgatcaagatggcagatctgacgataaatctagctgcgatctgtactccagcagattacaatacgcgtcctcttgacactatctacagcaatttcattgatgctctcccagtggttaaatactgctcagagaacaacaagcgtctgattcacttttccacttgtgaagtgtatggaaaaactataggaagctttcttccaaaggatcatcctctgcgtcaggatcctgaattttatgtactcaaagaagatatatccccttgcatctttggttcaattgagaagcagaggtggtcatatgcttgtgcaaagcaacttattgagagacttgtttacgctgagggtgctgagaatggactcgagttcaccattgtaagaccattcaactggattggacctaggatggatttcatccctggcattgatggtcctagcgagggtgtcccacgggttctagcgtgctttagtaacaatcttctgcgacgggagcctctcaagcttgtggatggtggagaatcacagagaaccttcatctacatcaaagatgctatcgaagctgtccttttgatgatcgaaaatccagagagagccaatgggcatatcttcaatgtaggcaacccaaacaatgaagtgacagtgagacaacttgctgaaatgatgactgaggtctacgccaaagtgagtggagagacagctatcgagagtccaacgatcgacgtgagctccaaagagttttatggagaaggttatgatgacagcgacaagagaatcccagacatgaccatcatcaaccgtcaacttggatggaacccgaagacgtcgctttgggacttgcttgaatcgaccttaacataccagcacacgacttatgcggaagccattaagaaggccacttcaaaaccagtcgcatcttagaggtcgtctctctttacaaacacctcaaatcatgtggtggctacgattccattctttctttttaaaaaaaaaattctcccaacagaaaccttctcttcccttattttaggccattctaaacaaatgatatatcatggtggttgattctagtttacgttttccttgttatatagtattactgttaatgtttttgaattcctttgttttgaagctttatatcttgtatttgtccgaaactaaaaagggaatggtttgtgcaaactataacattggggctttctttatatgttacatatctttggcggat

SEQ ID NO: 160 - protein, 389 aa, Arabidopsis thaliana
  misc_feature (1)..(389): Ceres ANNOT ID no. 863641
  misc_feature (1)..(389): Ceres GEMINI ID 5170H8
  misc_feature (1)..(389): Ceres SEED LINE ME18779
  misc_feature (20)..(290): Pfam Name: Epimerase Pfam Description: NAD dependent epimerase/dehydratase family
  misc_feature (1)..(389): Bit score of 1140 for HMM based on sequences of FIGURE 5.
MANGADRLDLDGKPIKPMTICMIGAGGFIGSHLCEKLMTETPHKVLALDVYNDKIKHLLEPDTVQWAGRIQFHRINIKHDSRLEGLIKMADLTINLAAICTPADYNTRPLDTIYSNFIDALPVVKYCSENNKRLIHFSTCEVYGKTIGSFLPKDHPLRQDPEFYVLKEDISPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTEVYAKVSGETAIESPTIDVSSKEFYGEGYDDSDKRIPDMTIINRQLGWNPKTSLWDLLESTLTYQHTTYAEAIKKATSKPVAS

SEQ ID NO: 161 - protein, 389 aa, Arabidopsis thaliana
  misc_feature (1)..(389): Public GI no. 14596185
  misc_feature (1)..(389): Functional Homolog of  Ceres ANNOT ID no. 863641 at SEQ ID NO. 160
  misc_feature (20)..(290): Pfam Name: Epimerase Pfam Description: NAD dependent epimerase/dehydratase family
  misc_feature (1)..(389): Bit score of 1128.4 for HMM based on sequences of FIGURE 5.
MANGADRLDLDGKPIKPMTICMIGAGGFIGSHLCEKLMTETPHKVLALDVYNDKIKHLLEPDTVQWAGRIQFHRINIKHDSRLEGLIKMADLTINLAAICTPADYNTRPLDTIYSNFIDALPVVKYCSENNKRLIHFSTCEVYGKTIGSFLPKDHPLRQDPEFYVLKEDISPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTEVYAKVSGETAIESPTIDVSSKEFYGEGYDDSDKRIPDMTIINRQLGCTPKTSLWDLLESTLTYQHTTYAEAIKKATSKPVAS

SEQ ID NO: 162 - protein, 388 aa, Zea mays
  misc_feature (1)..(388): Ceres CLONE ID no. 1459647
  misc_feature (1)..(388): Functional Homolog of  Ceres ANNOT ID no. 863641 at SEQ ID NO. 160
  misc_feature (20)..(289): Pfam Name: Epimerase Pfam Description: NAD dependent epimerase/dehydratase family
  misc_feature (1)..(388): Bit score of 1126.9 for HMM based on sequences of FIGURE 5.
MANGAVRLDLDGKPIKPLTICMIGAGGFIGSHLCEKLLTETPHKVLALDVYNDKIKHLLEPDTSEWAERIQFHRINIKHDSRLEGLVKMADLTINLAAICTPADYNTRPLDTIYSNFIDALPVVKYCSENNKRLIHFSTCEVYGKTIGSFLPKDHPLRQDPDFYVLKEDTSPCIFGSIEKQRWSYACAKQLIERLVYAGAENGLEFTIVRPFNWIGPRMDFIPGIDGPSEGVPRVLACFSNNLLRREPLKLVDGGESQRTFIYIKDAIDAVLLMIENPERANGRIFNVGNPNNEVTVRQLAEMMTKVYSKVSGETAIESPTIDVSSKEFYGEGYDDSDKRIPDMTIINRQLGWNPKTSLWDLLESTLTYQHRTYAEAVKKATSKPVAS

SEQ ID NO: 163 - protein, 389 aa, Arabidopsis thaliana
  misc_feature (1)..(389): Public GI no. 60547725
  misc_feature (1)..(389): Functional Homolog of  Ceres ANNOT ID no. 863641 at SEQ ID NO. 160
  misc_feature (20)..(290): Pfam Name: Epimerase Pfam Description: NAD dependent epimerase/dehydratase family
  misc_feature (1)..(389): Bit score of 1124.2 for HMM based on sequences of FIGURE 5.
MANGANRVDLDGKPIQPLTICMIGAGGFIGSHLCEKLLTETPHKVLALDVYNDKIKHLLEPDTVEWSGRIQFHRINIKHDSRLEGLVKMADLIINLAAICTPADYNTRPLDTIYSNFIDALPVVKYCSENNKRLIHFSTCEVYGKTIGSFLPKDHPLRDDPAFYVLKEDISPCIFGSIEKQRWSYACAKQLIERLVYAEGAENGLEFTIVRPFNWIGPRMDFIPGIDGPSEGVPRVLACFSNNLLRREPLKLVDGGESQRTFVYINDAIEAVLLMIENPERANGHIFNVGNPNNEVTVRQLAEMMTEVYAKVSGEGAIESPTVDVSSKEFYGEGYDDSDKRIPDMTIINRQLGWNPKTSLWDLLESTLTYQHRTYAEAVKKATSKPVAS

SEQ ID NO: 164 - DNA, 1170 bp, Populus balsamifera subsp. trichocarpa
  misc_feature (1)..(1170): Ceres ANNOT ID no. 1541782
atggcatcatcagtggtgagggttgatcttgatggaaaaccaataaatccgctaacaatttgcatgatcggtgctggtggtttcattgggtcccacctgtgtgagaagatcttgaacgagactcaacacaagatcttagcccttgatgtttacaatgacaagatcaagcaccttctcgaaccggacagcctcccttgggctggccggatccagttccaccgtatcaatatcaaacacgactctcgcctcgaaggcctcatcaagatgtcagatctgacgataaatctggctgcgatctgtactccggcggattataatacgcgtcctttggatacgatttatagcaactttatcgacgcgttgcctgtggcgaagtactgttcagagaatgggaagcgtctgattcacttctcgacttgtgaagtgtatgggaaaactattgggagttttcttcctaaagacagtcctcttcgtcaggatcctgcatattatgtgcttaaagaagatgcctctccctgcatttttggttccattgagaagcagagatggtcttatgcgtgtgcaaagcaattgattgagaggctggtttatgctgagggtgcagagaatggacttgagttcaccatcgtgaggcctttcaactggattggacccagaatggattttattcccggtgttgatggcccaagtgagggcgttccccgggttcttgcttgctttagcaatgctcttcttcgccgggagccgctcaagcttgtggatggtggcgaatcccagagaacatttgtttatattaaggatgccatcgaggctgttctcttgatgattgaaaatccttccagggccaatggtcatatttttaacgttggcaaccctaacaatgaagtcactgtgaggcagcttgctgaaatgatgacagcggtctacgcaaatgtaagtggagaacctgctctggaggaaccgacagttgatgtcagctccaaagagttctacggtgagggatatgacgatagtgacaagagaattccagacatgaccataatcaatagacaacttggttggaaccccaagacgtctctgtgggacttgctcgattcaaccctcacttatcaacacaagacttatgccgaggcaatcaagaaggtcatgtcacaacccacaaccagctga

SEQ ID NO: 165 - protein, 389 aa, Populus balsamifera subsp. trichocarpa
  misc_feature (1)..(389): Ceres ANNOT ID no. 1541782
  misc_feature (1)..(389): Functional Homolog of  Ceres ANNOT ID no. 863641 at SEQ ID NO. 160
  misc_feature (20)..(290): Pfam Name: Epimerase Pfam Description: NAD dependent epimerase/dehydratase family
  misc_feature (1)..(389): Bit score of 1130.1 for HMM based on sequences of FIGURE 5.
MASSVVRVDLDGKPINPLTICMIGAGGFIGSHLCEKILNETQHKILALDVYNDKIKHLLEPDSLPWAGRIQFHRINIKHDSRLEGLIKMSDLTINLAAICTPADYNTRPLDTIYSNFIDALPVAKYCSENGKRLIHFSTCEVYGKTIGSFLPKDSPLRQDPAYYVLKEDASPCIFGSIEKQRWSYACAKQLIERLVYAEGAENGLEFTIVRPFNWIGPRMDFIPGVDGPSEGVPRVLACFSNALLRREPLKLVDGGESQRTFVYIKDAIEAVLLMIENPSRANGHIFNVGNPNNEVTVRQLAEMMTAVYANVSGEPALEEPTVDVSSKEFYGEGYDDSDKRIPDMTIINRQLGWNPKTSLWDLLDSTLTYQHKTYAEAIKKVMSQPTTS

SEQ ID NO: 166 - DNA, 1170 bp, Populus balsamifera subsp. trichocarpa
  misc_feature (1)..(1170): Ceres ANNOT ID no. 1460446
atggcagcatcaacggtgaggattaatcttgatggaaaaccgataaatcagctaacaatattgatgatcggtgccggtggtttcatcgggtcccacctctgtgagaagatcttgcaggaaactccacacaagatcctagctcttgatgtttacagtgacaagatcaagcaccttctcgaaccggatagtctcgaatgggctggccggatccagtttcaccgtatcaatattaagcacgattctcgcctcgaaggcctaattaagatgtcagatctgacgataaatctggcggcgatctgtactccagcggattataatacgcgtcctttggatacgatttatagcaactttattgacgcgctgcccgtggtgaagtactgttcagagaatgggaagcgtttgattcacttctcgacttgtgaagtgtatggaaaaactattggtagttttcttcctaaagatagtcctcttcgtcaggaccctgcatactatgtcctcaaagaagatgcctctccctgcattttcggttctatcgagaagcagaggtggtcctatgcatgtgcaaagcagttgattgagaggttgatttatgctgagggtgcagagaatgggcttgagttcaccattgtgaggcccttcaactggattggacccagaatggatttcatacccggcattgatggcccaagtgagggtgttcccagggttctggcatgcttcagcaatgctcttcttcgtcgtgagcaactcaagcttgttgatggtggtgaatcccagagaacttttgtttacatcaaggatgccatagaggcggtcctcttgatgattgaaaatcctgacagggccaacggtcatatttttaatgttggcaaccctaacaatgaagtcactgttaggcagcttgctgaaatgatgacagcggtctacgcaaacgtaagtggcgaacctgcactggaggaacccacagttgatgtcagctccaaagagttctacggtgaaggatatgacgatagtgacaagagaattccagacatgaccataatcaataaacaacttggttggaaccccaagacatctgtgtgggacttgcttgattcaaccctcacttatcaacacaagacgtatgccgaggcagtcaagaaggttatctcaaaacccacaaccagctga

SEQ ID NO: 167 - protein, 389 aa, Populus balsamifera subsp. trichocarpa
  misc_feature (1)..(389): Ceres ANNOT ID no. 1460446
  misc_feature (1)..(389): Functional Homolog of  Ceres ANNOT ID no. 863641 at SEQ ID NO. 160
  misc_feature (20)..(290): Pfam Name: Epimerase Pfam Description: NAD dependent epimerase/dehydratase family
  misc_feature (1)..(389): Bit score of 1104.7 for HMM based on sequences of FIGURE 5.
MAASTVRINLDGKPINQLTILMIGAGGFIGSHLCEKILQETPHKILALDVYSDKIKHLLEPDSLEWAGRIQFHRINIKHDSRLEGLIKMSDLTINLAAICTPADYNTRPLDTIYSNFIDALPVVKYCSENGKRLIHFSTCEVYGKTIGSFLPKDSPLRQDPAYYVLKEDASPCIFGSIEKQRWSYACAKQLIERLIYAEGAENGLEFTIVRPFNWIGPRMDFIPGIDGPSEGVPRVLACFSNALLRREQLKLVDGGESQRTFVYIKDAIEAVLLMIENPDRANGHIFNVGNPNNEVTVRQLAEMMTAVYANVSGEPALEEPTVDVSSKEFYGEGYDDSDKRIPDMTIINKQLGWNPKTSVWDLLDSTLTYQHKTYAEAVKKVISKPTTS

SEQ ID NO: 168 - protein, 386 aa, Solanum tuberosum
  misc_feature (1)..(386): Public GI no. 85718018
  misc_feature (1)..(386): Functional Homolog of  Ceres ANNOT ID no. 863641 at SEQ ID NO. 160
  misc_feature (17)..(287): Pfam Name: Epimerase Pfam Description: NAD dependent epimerase/dehydratase family
  misc_feature (1)..(386): Bit score of 1124.1 for HMM based on sequences of FIGURE 5.
MAGRVDLDGNPIKPMTICMIGAGGFIGSHLCEKLMSETPHTVLAVDVYSDKIKHLLEPTSLPWNGRIQFHRINIKNDSRLEGLIKMADLTVNLAAICTPADYNTRPLDTIYSNFIDALPVVKYCSENGKRLIHFSTCEVYGKTIGAFLPEDSPLRQDPAYFVLSEEASPCIFGPIEKQRWSYACAKQLIERLIYAEGAENGLEFTIVRPFNWIGPRMDFIPGIDGPSEGVPRVLACFSNNLLRHEPLKLVDGGHSQRTFIYIKDAIEAVFLMIENPARANGHIFNVGNPNNEVTVKQLAEMMTQVYSKVSGETPLETPTVDVSSKEFYGEGYDDSDKRIPDMTIINRQLGWNPKTSLWDLLESTLTYQHRTYAEAVKQAMSKTTAN

SEQ ID NO: 169 - protein, 387 aa, Nicotiana benthamiana
  misc_feature (1)..(387): Public GI no. 37379419
  misc_feature (1)..(387): Functional Homolog of  Ceres ANNOT ID no. 863641 at SEQ ID NO. 160
  misc_feature (18)..(288): Pfam Name: Epimerase Pfam Description: NAD dependent epimerase/dehydratase family
  misc_feature (1)..(387): Bit score of 1119.6 for HMM based on sequences of FIGURE 5.
  misc_feature (152)..(152): Xaa is any aa, unknown, or other
  misc_feature (365)..(365): Xaa is any aa, unknown, or other
MAGGRVDLDGNVIKPMKICMIGAGGFIGSHLCEKLMNETPHTVLAVDVYSDKIKHLLEPADLPWTGRIQFHRINIKNDSRLEGLIKMADLVVNLAAICTPADYNTRPLDTIYSNFIDALPVVKYCSENGKRLIHFSTCEVYGKTIGAFLPEXSPLRQDPAYYVLKEDVSPCIFGSIEKQRWSYACAKQLIERLIYAEGAENGLEFTIVRPFNWIGPRMDFIPGIDGPSEGVPRVLACFSNNLLRHEPLKLVDGGHSQRTFIYIKDAIEAVLLMIENPARANGQIFNVGNPNNEVTVRQLAEMMTQVYSKVSGESPPETPTIDVSSKEFYGEGYDDSDKRIPDMTLINRQLGWNPKTSLWDLLESXLTYQHRTYAEAVKQAMSKTTAN

SEQ ID NO: 170 - protein, 394 aa, Zea mays
  misc_feature (1)..(394): Ceres CLONE ID no. 300029
  misc_feature (1)..(394): Functional Homolog of  Ceres ANNOT ID no. 863641 at SEQ ID NO. 160
  misc_feature (24)..(294): Pfam Name: Epimerase Pfam Description: NAD dependent epimerase/dehydratase family
  misc_feature (1)..(394): Bit score of 1098.3 for HMM based on sequences of FIGURE 5.
MSSSPSPAATRLDLDGNPIAPLTICMIGAGGFIGSHLCEKLMAETHHTVLAVDVYCDKIRHLVDPAPPHLAGRISFHRLNIKNDSRLEGLIKMADLTINLAAICTPADYNTRPLDTIYSNFIDALPVVKYCSENSKRLIHFSTCEVYGKTIGSFLPKDHPLRKEPEFYVLKEDESPCIFGPIVKQRWSYACAKQLIERLVFAEGAENGLDFTIVRPFNWIGPRMDFIPGVDGPSEGVPRVLACFSNNLLRREPLKLVDGGQSQRTFVYIKDAIEAVVLMIENPARANGHIFNVGNPNNEVTVRELAQMMTEVYANVSGEAPLDEPMIDVSSSQFYGEGYDDSDKRIPDMTIINKQLGWNPKTPLKDLLETTLTYQHKTYKEAVKRQMSQASAST

SEQ ID NO: 171 - protein, 398 aa, Oryza sativa subsp. japonica
  misc_feature (1)..(398): Public GI no. 34905954
  misc_feature (1)..(398): Functional Homolog of  Ceres ANNOT ID no. 863641 at SEQ ID NO. 160
  misc_feature (28)..(298): Pfam Name: Epimerase Pfam Description: NAD dependent epimerase/dehydratase family
  misc_feature (1)..(398): Bit score of 1113 for HMM based on sequences of FIGURE 5.
MSSSSSPPAASAAARLDLDGNPIAPLTICMIGAGGFIGSHLCEKLMAETAHVVYAVDVYCDKIRHLVDPAPPHLHGRISFHRLNIKNDSRLEGLIKMADLTINLAAICTPADYNTRPLDTIYSNFIDALPVVKYCSENNKRLIHFSTCEVYGKTIGSFLPTDHPLRKEPEFYVLKEDESPCIFGPIVKQRWSYACAKQLIERLIFAEGAENGLEFTIVRPFNWIGPRMDFIPGVDGPSEGVPRVLACFSNNLLRREPLKLVDGGQSQRTFVYIKDAIEAVHLMIENPARANGQIFNVGNPNNEVTVRQLAEMMTEVYANVSGEPPLDEPMIDVSSKQFYGEGYDDSDKRIPDMTIINKQLGWNPKTPLKDLLETTLTYQHKTYKEAIKRQMSQASASS

SEQ ID NO: 172 - protein, 372 aa, Medicago truncatula
  misc_feature (1)..(372): Public GI no. 92894433
  misc_feature (1)..(372): Functional Homolog of  Ceres ANNOT ID no. 863641 at SEQ ID NO. 160
  misc_feature (21)..(273): Pfam Name: Epimerase Pfam Description: NAD dependent epimerase/dehydratase family
  misc_feature (1)..(372): Bit score of 1036.1 for HMM based on sequences of FIGURE 5.
MCSPSSTRLNLDGNPIKPITICIIGAGGFIGSHLCEKLMLQTPHKVLALDVYSDKLKHLLEPDTLPWNNRIDYHSLNIKNDSRLEGLIKIADLVINLAAICTPADYNTRPLDTIYSNFVDAIPVVYGKTIGSFLSKDSPLRHDPAYYMLKEDESPCIFGPIEKQRWSYACAKQLIERLIYGEGDEKGLEFTIVRPFNWIGPRMDFIPGVDGPSEGVPRVLACFSNNLLRGEPLKLVDGGESQRTFLYIKDAIEAVLLMIENPARANGKIFNVGNPNNEVTVRELAEMMIKVYSKVSGDQPLETPTIDVSSKEFYGEGYDDSDKRIPDMTIINKQLGWNPKTSLEDLLESTLTYQHKTYAEAIKKVIAQTIAS

SEQ ID NO: 173 - protein, 395 aa, Zea mays
  misc_feature (1)..(395): Public GI no. 42602317
  misc_feature (1)..(395): Functional Homolog of  Ceres ANNOT ID no. 863641 at SEQ ID NO. 160
  misc_feature (24)..(294): Pfam Name: Epimerase Pfam Description: NAD dependent epimerase/dehydratase family
  misc_feature (1)..(395): Bit score of 1077.5 for HMM based on sequences of FIGURE 5.
MSSSPSPAATRLDLDGNPIAPLTICMIGAGGFIGSHLCEKLMAETHHTVLAVDVYCDKIRHLVDPAPPHLAGRISFHRLNIKNDSRLEGLIKMADLTINLAAICTPADYNTRPLDTIYSNFIDALPVVKYCSENSKRLIHFPTCEVYGKTIGSFLPKDHPLRKEPEFYVLKEDESPCIFGPIVKQRWSYACAKQLIERLVFAEGAENGLDFTIVRPFNWIGPRMDFIPGVDGPSEGVPRVLACFSNNLLRREPLKLVDGGQSQRTFVYIKDAIEAVVLMIENPARANGHIFNVGNPNNEVTVRELAPMMTEVYTQMSQGEAPLDEPMIDVSSSQFYGEGYDDSDKRIPDMTIINKQLGWNPKTPLKDLLETTLTYQHKTYKEAAKRQMSQASAST

SEQ ID NO: 174 - protein, 396 aa, Zea mays
  misc_feature (1)..(396): Ceres CLONE ID no. 243057
  misc_feature (1)..(396): Functional Homolog of  Ceres ANNOT ID no. 863641 at SEQ ID NO. 160
  misc_feature (26)..(296): Pfam Name: Epimerase Pfam Description: NAD dependent epimerase/dehydratase family
  misc_feature (1)..(396): Bit score of 1083 for HMM based on sequences of FIGURE 5.
MSSSLSPAAAAAPLDLDGNSVAPLTICMIGAGGFIGSHLCEKLMAETRHVVLAVDVYCDKIRHLVDPAPPHLAGRISFHRLNIKNDSRLEGLIKMADLTINLAAICTPADYNTRPLDTIYSNFIDALPVVKYCSENSKRLIHFSTCEVYGKTIGSFLPKDHPLRKEPEFYVLKEDESPCIFGPIVKQRWSYACAKQLIERLIFAEGAENGLEFTIVRPFNWIGPRMDFIPGVDGPSEGVPRVLACFSNNLLRREPLKLVDGGQSQRTFVYIKDAIEAVVLMIENPARANGHIFNVGNPDNEVTVRELAQMMTEVYANVSGEAPLDEPMIDVSSSQFYGEGYDDSDKRIPDMTIINKQLGWNPKTPLKDLLETTLTYQHKTYKEAVKRQMSQASATS

SEQ ID NO: 175 - DNA, 405 bp, Arabidopsis thaliana
  misc_feature (1)..(405): Ceres ANNOT ID no. 867623
  misc_feature (1)..(405): Ceres GEMINI ID 5118G1
  misc_feature (1)..(405): Ceres SEED LINE ME13394
atcacaacacaaatcaaaacaagaataacaaaatctttctcttataaattcttatttcaagacatcaaaggagaattaatggaggcaatgaagatgaagatgatggtgtttattatggttgttgcggtggctttctcagctgccacggctgctaccgttgaagctccagctccaagcccaacttctgatgctgccatgtttgtaccagcactgtttgcatctgttgttgctttggcatctggtttcatcttttgatcattctttttttcttcattatttaattgcatttgttaatgagtttgcgtgatttgattctctattgttagaatgttgcattcttatttcttaatgtaaccatctgtttctctatgtatctatgtgtattatcaattcatcactgtttat

SEQ ID NO: 176 - protein, 58 aa, Arabidopsis thaliana
  misc_feature (1)..(58): Ceres ANNOT ID no. 867623
  misc_feature (1)..(58): Ceres GEMINI ID 5118G1
  misc_feature (1)..(58): Ceres SEED LINE ME13394
  misc_feature (1)..(58): Bit score of 125.4 for HMM based on sequences of FIGURE 6.
MEAMKMKMMVFIMVVAVAFSAATAATVEAPAPSPTSDAAMFVPALFASVVALASGFIF

SEQ ID NO: 177 - protein, 59 aa, Brassica napus
  misc_feature (1)..(59): Ceres CLONE ID no. 873156
  misc_feature (1)..(59): Functional Homolog of  Ceres ANNOT ID no. 867623 at SEQ ID NO. 176
  misc_feature (1)..(59): Bit score of 137.2 for HMM based on sequences of FIGURE 6.
MEAMKMMVVFMVVAVAFSAIGQATAATVEAPAPSPTSDAAMFVPALFASVVALASGLLF

SEQ ID NO: 178 - protein, 59 aa, Brassica rapa
  misc_feature (1)..(59): Public GI no. 83032230
  misc_feature (1)..(59): Functional Homolog of  Ceres ANNOT ID no. 867623 at SEQ ID NO. 176
  misc_feature (1)..(59): Bit score of 134.8 for HMM based on sequences of FIGURE 6.
MEAKKMMVVFMIVAVAFSAVGQAAAATVEAPAPSPTSDAAMFVPALFASVVALASGLLF

SEQ ID NO: 179 - protein, 58 aa, Brassica napus
  misc_feature (1)..(58): Ceres CLONE ID no. 971850
  misc_feature (1)..(58): Functional Homolog of  Ceres ANNOT ID no. 867623 at SEQ ID NO. 176
  misc_feature (1)..(58): Bit score of 128.1 for HMM based on sequences of FIGURE 6.
MAMKMMVVFMVVAVAFSAVGQAAAATVEAPAPSPTSDAAMFVPTLFASVVALASGLLF

SEQ ID NO: 180 - protein, 58 aa, Glycine max; identical to SEQ ID NO: 179
  misc_feature (1)..(58): Ceres CLONE ID no. 1121732
  misc_feature (1)..(58): Functional Homolog of  Ceres ANNOT ID no. 867623 at SEQ ID NO. 176
  misc_feature (1)..(58): Bit score of 128.1 for HMM based on sequences of FIGURE 6.

SEQ ID NO: 181 - protein, 59 aa, Medicago truncatula
  misc_feature (1)..(59): Public GI no. 92881787
  misc_feature (1)..(59): Functional Homolog of  Ceres ANNOT ID no. 867623 at SEQ ID NO. 176
  misc_feature (1)..(59): Bit score of 134.4 for HMM based on sequences of FIGURE 6.
MEALKMKQFFAMLVVAMMMAASSVSAADAPAPSPTSDATTLFVPTIIASFVALVFGLLF

SEQ ID NO: 182 - DNA, 1455 bp, Arabidopsis thaliana
  misc_feature (1)..(1455): Ceres ANNOT ID no. 868753
  misc_feature (1)..(1455): Ceres GEMINI ID 5153D9
  misc_feature (1)..(1455): Ceres SEED LINE ME17696
ctctctctctctccatttaccatgactttcaataagaggcaagtcaagatcaatcactggccggagaagaacgacaaagagaagcagaaatactccaaaaacagagaaaccgtcaagttgacacttctcactcttcttctcctttgctcaatttgtttcctcttcctaactctcaatttccccttcacaatagaattcacagcctcaatccctcgcacatgcgaccacaatttcaccgtctacgtgtacgatctccccaaagagttcaacatcggtctcctccaaaattgccgacacttaaacatctacaccaacatgtgccctcacgtggccaacaatggccttggacagcctcttcaccgcggacgaacttcgtggttctctacgcaccagttcatagccgagatgatcttccacgcacgtgtcgaaaaccatccatgccgcacgtatgagccagacactgccgacatcttctacgtccctttctacggtggtctctacgcttcaagcgtgttccgagagcaaaacctgaccaagcgcgacgagctagctgtcagattagtcaactacattagtggccaacgatggtggaagagaagcaacggtcgtgatcatttcttggccatagggaggacagcttgggatttcatgcgctcctccgacactgactttggagctaacatgctcatgcaaatgccacgtgtcatgaacatgtcggtgctgaccgtggagaggcagccttggaatggtgacaatcactttggtataccgtatccttcttattttcatccgtacacgtcagcagaaatggtgacgtggcaggacaagatgaaaaatgtcgagagaccaaacttgtttagttttgtcggtgggccgagaaagggcttggagaaagctgccattagagacgagctgatcaagcaatgcgctgagtcgagccattgtgagcttctcaagtgtgaaaatggagggtccaggtgtcacaacccaatgacggtattaggagtgatggctaggtcacggttttgcctacaagcaccgggggactcattcacgcggagatcaacattcgatgcgatgttagccgggtgcataccggtctttttttcaccccacactatgtatacacagtacatgtggtatcttccggacgataaaagaagttactcagtgttcatggacgaaaagaacaacactcatatagaacaagagctcttgaggatctcggagaacgaagtggttcaaatgagagaaatagtcatcgatttgatcccgagactgacttatgcgcacccaaactctactaactatgatttaccagatgcggttgatatagcgttagaggcactagctaagcaagcaagagacaatgttgtggtttcattgtaagacctatagttttgtgctactcagatgtaactaatcccaaagaataaagaattgtagtgttcagac

SEQ ID NO: 183 - protein, 455 aa, Arabidopsis thaliana
  misc_feature (1)..(455): Ceres ANNOT ID no. 868753
  misc_feature (1)..(455): Ceres GEMINI ID 5153D9
  misc_feature (1)..(455): Ceres SEED LINE ME17696
  misc_feature (73)..(413): Pfam Name: Exostosin Pfam Description: Exostosin family
  misc_feature (1)..(455): Bit score of 1408.1 for HMM based on sequences of FIGURE 7.
MTFNKRQVKINHWPEKNDKEKQKYSKNRETVKLTLLTLLLLCSICFLFLTLNFPFTIEFTASIPRTCDHNFTVYVYDLPKEFNIGLLQNCRHLNIYTNMCPHVANNGLGQPLHRGRTSWFSTHQFIAEMIFHARVENHPCRTYEPDTADIFYVPFYGGLYASSVFREQNLTKRDELAVRLVNYISGQRWWKRSNGRDHFLAIGRTAWDFMRSSDTDFGANMLMQMPRVMNMSVLTVERQPWNGDNHFGIPYPSYFHPYTSAEMVTWQDKMKNVERPNLFSFVGGPRKGLEKAAIRDELIKQCAESSHCELLKCENGGSRCHNPMTVLGVMARSRFCLQAPGDSFTRRSTFDAMLAGCIPVFFSPHTMYTQYMWYLPDDKRSYSVFMDEKNNTHIEQELLRISENEVVQMREIVIDLIPRLTYAHPNSTNYDLPDAVDIALEALAKQARDNVVVSL

SEQ ID NO: 184 - DNA, 1467 bp, Populus balsamifera subsp. trichocarpa
  misc_feature (1)..(1470): Ceres ANNOT ID no. 1441800
atggttgtcaagaaaaaatctatatcatctgcatctccatggtcgacggagaaagggaagtactctaaaaccaacgaaatacattactcattccttaaaccacagttgagacacgctctactactctgtttcttgctttctgtttggtttgttattctaagatgttttctcttgtcctcctccacgagcgaaaacaacatcgagaaactaaacgtagatgaaaaggcgcccaagacaacatcgaaatcatctgcgatatccaagtgtgaaggaggaatgtcagtgtatttatatgacatgcccgctgagttcaacaagggtttacttaaagattgcagccatctaaatccttacactgacatgtgtcctcatgtggcaaatcgcggattaggccaaccactctcctacatggcagagtccgccgtcgccaccacatggtttgccacccaccagttcattgcggagatgatttttcacgctcgtatggagaaccatccatgtcgtgttttggatcctataaatgccaagctattctacgtgccattctatggtggactcgatgcctcaagcaagttccacgatgcaaatctcacggcacgcgatgaactagccgtccgattagcagattatctccgatcaaaaccatggtgggagaggcatcacggtaaggaccatttcttagtcctaggaaggaccgcatgggatttcttgagaagaaataacgactttggaaactctctcctaaatctgccagacgtgcaaaacatgtcggtgctgactgtagagcgaaacccttgggatcgagtccacaaccaacatggcatcccttacccttcctatttccacccgtacacgtcacacgagatgatgacgtggcagaacaagatgagacaatcaagtaggccccacctcttctcctttataggggggccacgtagaggagttgagaaagctgctgtaagggacgagttaataaggcagtgcagcgagtcaggtcgctgcaagcttctaaaatgtgggaaaggacccagtaaatgccatgacccaattgaggtacttaaggtgatgtctcagtcccagttttgcttgcaagctcccggtgactcgttcactcggaggtcaacttttgactcagtgttggcaggttgcatacctgtgtttttctcacctcacactgtgtatactcagtatgagtggttttttccagctggggatgcgagagagtattcagtttacatagatgaaaatgctttgaagacgggaaatggaagcaaaagggtagttagcattgaggaagagcttttcaagattgagagagagaaggtggagagaatgagaagcgcagtaataaatttgatgccgagactcacctatgcacaccctaatgcgactgatctagggtttcaagatgctgtggatgttgcccttgaggcattgtgggccaagcgtttgaagttgaacgtctaa

SEQ ID NO: 185 - protein, 488 aa, Populus balsamifera subsp. trichocarpa
  misc_feature (1)..(488): Ceres ANNOT ID no. 1441800
  misc_feature (1)..(488): Functional Homolog of  Ceres ANNOT ID no. 868753 at SEQ ID NO. 183
  misc_feature (95)..(449): Pfam Name: Exostosin Pfam Description: Exostosin family
  misc_feature (1)..(488): Bit score of 1520.6 for HMM based on sequences of FIGURE 7.
MVVKKKSISSASPWSTEKGKYSKTNEIHYSFLKPQLRHALLLCFLLSVWFVILRCFLLSSSTSENNIEKLNVDEKAPKTTSKSSAISKCEGGMSVYLYDMPAEFNKGLLKDCSHLNPYTDMCPHVANRGLGQPLSYMAESAVATTWFATHQFIAEMIFHARMENHPCRVLDPINAKLFYVPFYGGLDASSKFHDANLTARDELAVRLADYLRSKPWWERHHGKDHFLVLGRTAWDFLRRNNDFGNSLLNLPDVQNMSVLTVERNPWDRVHNQHGIPYPSYFHPYTSHEMMTWQNKMRQSSRPHLFSFIGGPRRGVEKAAVRDELIRQCSESGRCKLLKCGKGPSKCHDPIEVLKVMSQSQFCLQAPGDSFTRRSTFDSVLAGCIPVFFSPHTVYTQYEWFFPAGDAREYSVYIDENALKTGNGSKRVVSIEEELFKIEREKVERMRSAVINLMPRLTYAHPNATDLGFQDAVDVALEALWAKRLKLNV

SEQ ID NO: 186 - DNA, 460 bp, Gossypium hirsutum
  misc_feature (1)..(460): Ceres CLONE ID no.1924705
aacgcatcaaatttaggtggtgttttcttttcatcttcctactaccctttgatttccctttcagtgttttgtgataaacaatagtttttagactattaatttacttctctctttgctgtattacccttcaattcctagtcggctgcagcggcaatttcttctctttgtctccgtgttttcagtcactttccccatgttgctgtcaaagaaacaaccctctgctgctgcaactcaatggatagagaaagtcaaataccataaaaatagagattcctacttcaagttcttgggcaatcctcactttagatacactgcctttcttttggtgtttctttctttatggtttttgttacaagtcttttggttcccacccacaaaacccacccaaaccaagttctccaccaccaccccaaagccatcggccgggaaatgtaatggggatgtcgcggtttatgtgtat

SEQ ID NO: 187 - protein, 475 aa, Gossypium hirsutum
  misc_feature (1)..(475): Ceres CLONE ID no. 1924705
  misc_feature (1)..(475): Functional Homolog of  Ceres ANNOT ID no. 868753 at SEQ ID NO. 183
  misc_feature (86)..(435): Pfam Name: Exostosin Pfam Description: Exostosin family
  misc_feature (1)..(475): Bit score of 1483.4 for HMM based on sequences of FIGURE 7.
MLLSKKQPSAAATQWIEKVKYHKNRDSYFKFLGNPHFRYTAFLLVFLSLWFLLQVFWFPPTKPTQTKFSTTTPKPSAGKCNGDVAVYVYNLPAEFNLGLLDDCSHLNVYTNMCPHVANHGLGQPLDNMDLQSSDSNPWFATHQFIAEMIFHARVENHPCRTWDPSKANLFYVPFYGGLHVSSNFREPNHAIRDALAVRLVDFLQAQPTWRKKNGKDHFLALGRTSWDFMRANSGPDFGANCLLNLPCVKNMSVLTVERNPWKGSNQHGIPYPSYFHPSTSDQMMTWQNMMQQSNRPYLFSFIGAPRKGVGKAAIRDEMIKQCMESTQCKILKCDHGNPKCYNPSEILKVMRESRFCLQAPGDSFTRRSTFDAILSGCIPVFFSRHTAYTQYSWFLPEEASKYSVYMDEQSEESKRIEEVLMKIPKEEVDTMRATVIDMIPRLTYAHPNASHSDLGFEDAVDVALQALAQHVRDKV

SEQ ID NO: 188 - protein, 465 aa, Glycine max
  misc_feature (1)..(465): Ceres CLONE ID no. 624590
  misc_feature (1)..(465): Functional Homolog of  Ceres ANNOT ID no. 868753 at SEQ ID NO. 183
  misc_feature (79)..(424): Pfam Name: Exostosin Pfam Description: Exostosin family
  misc_feature (1)..(465): Bit score of 1421 for HMM based on sequences of FIGURE 7.
MFFRKPSPTPPLHSLSSLPSTAISFSKTKDPHNNKLRYTIFSCLFLASWLLILHRFNFTILAPSTTTTTPTCDGSKPLFYIYNLPSRFNLGLLERCQSLNIYTNMCPHVANNGLGQPLSTPDWYSTHQFIAEMIVHARLENHPCRTWDPYTAVLFYVPFYGGLYASSVFREANLTLRDSLAVDLVDFLQSQPWWKRHYGKDHFVALGRTAWDFMRTEGGSDFGANIFLNLPPVLNMSVLTVERQPWRGHNQFAIPYPSYFHPKTLAQTLTWQSHLRRRARPHLFSFVGGTRPGLQKAKVRDHIVSQCQASKRCVLVRCASGDSKCHNPMNVLEVMEKSTFCLQAPGDSFTRRSTFDSVLAGCIPVFFSEHTAYTQYKWYFPRERDTYSVFIDEREVIEGKEKMMIEEVLLGFGEKEVERMREVLIGLIPTLTYAHPNATAAFPDVVDVMLRRLSRRVTHHFNPII

SEQ ID NO: 189 - DNA, 1219 bp, Arabidopsis thaliana
  misc_feature (1)..(1219): Ceres ANNOT ID no. 869790
  misc_feature (1)..(1219): Ceres GEMINI ID 5141F3
  misc_feature (1)..(1219): Ceres SEED LINE ME20794
agaaactcctcactttcgaaaaaaacaagatcattacacaaaaatgggacacctaattcctcaaaccggagatgaagagaccgagcttggtttagctgcggttaggctagctaactgtgcagccttcccaatggttttcaaagctgccatcgagctcggtgtcatcgacactctctacttagctgctcgtgatgacgtcaccggatccagttccttcctcacaccttctgagatagctattaggctccccacaaaacctagtaaccctgaagcaccagctctgttggatcgtattcttcgtttacttgctagctactccatggtcaagtgccaaattatcgatggtaacagagtctacaaagcagagccgatttgtcgatatttcttgaaagataatgttgatgaagaattaggaacacttgcttctcaacttattgtcactctcgataccgtcttcctcaatacatggggagaattaaaaaatgtggtactagaaggaggagttgcatttggccgtgccaatggtggtttgaaactctttgactatattagcaaagatgagagattaagcaaactctttaaccggaccggattctctgtcgcggttttgaaaaagatcctacaagtttatagtggtttcgaaggagttaatgtgttggttgatgtaggaggtggagttggtgacacacttggttttgttacttcaaagtatccaaacattaagggtatcaattttgatctaacttgtgctttaacacaagctccttcttatcctaatgtggaacatgtagctggagacatgtttgttgatgtcccaaaaggtgatgctatcctcttgaaacgtatacttcatgactggactgatgaagactgtgaaaagattctcaagaattgttggaaagcattacctgagaatgggaaagtgattgtcatggaagtagttactccagatgaagcagataatcgtgatgtgatatccaacattgcttttgatatggatctgttgatgctcactcaattatctggaggtaaagagaggtcgcgggccgagtatgtagctatggctgctaactcgggttttccgcgttgcaactttgtatgcagtgcatatcatttgtgggtcattgagttaacgaaacaggcttagagttgtaagattatgtttcttcctgtgttctataaagagtgtgaaccgtctcatggtaataaaagttgtatg

SEQ ID NO: 190 - protein, 367 aa, Arabidopsis thaliana
  misc_feature (1)..(367): Ceres ANNOT ID no. 869790
  misc_feature (1)..(367): Ceres GEMINI ID 5141F3
  misc_feature (1)..(367): Ceres SEED LINE ME20794
  misc_feature (30)..(89): Pfam Name: Dimerisation Pfam Description: Dimerisation domain
  misc_feature (99)..(342): Pfam Name: Methyltransf_2 Pfam Description: O-methyltransferase
  misc_feature (1)..(367): Bit score of 718.5 for HMM based on sequences of FIGURE 16.
MGHLIPQTGDEETELGLAAVRLANCAAFPMVFKAAIELGVIDTLYLAARDDVTGSSSFLTPSEIAIRLPTKPSNPEAPALLDRILRLLASYSMVKCQIIDGNRVYKAEPICRYFLKDNVDEELGTLASQLIVTLDTVFLNTWGELKNVVLEGGVAFGRANGGLKLFDYISKDERLSKLFNRTGFSVAVLKKILQVYSGFEGVNVLVDVGGGVGDTLGFVTSKYPNIKGINFDLTCALTQAPSYPNVEHVAGDMFVDVPKGDAILLKRILHDWTDEDCEKILKNCWKALPENGKVIVMEVVTPDEADNRDVISNIAFDMDLLMLTQLSGGKERSRAEYVAMAANSGFPRCNFVCSAYHLWVIELTKQA

SEQ ID NO: 191 - DNA, 1228 bp, Arabidopsis thaliana
  misc_feature (1)..(1228): Ceres ANNOT ID no. 869854
  misc_feature (1)..(1228): Ceres GEMINI ID 5146A4
  misc_feature (1)..(1228): Ceres SEED LINE ME18127
acattaatttcttataaccaacaacaataatgacaaaccatcttcaagatcccttacctacttacccaaaaccggttttaaccaaagaagaacaagaagtggacgagaaaatggtaagcttgcaagcagagagtatcgtgaacaccgtggctttccctatggttctcaaagccgccttcgagcttggcgtcatcgacaccatcgctgctgcaggaaacgacacgtggctctcaccgtgtgagatagcgtgtagtctcccaaccaaacccaccaacccggaggcgccggtgttgcttgaccggatgctgagcttacttgtcagccactcgatcttgaagtgccgtatgattgaaaccggagagaacggtcgaaccggaaagatcgagagggtatatgcagccgaaccggtttgcaagtattttttgagagatagtgatggtacaggatctctcgtgcctctgttcatgttgctccatacccaagtgtttttcaagacttggacaaatcttaaagatgtgatactagaaggaagagatgcattcaactctgcccacggcatgaaaatcttcgaatacataaattcggatcaaccatttgctgagttgtttaatcgtgcaatgtcggaaccttccaccatgatcatgaagaaggttctagacgtatatagaggatttgaagatgttaacactttggtggatgttggaggaggaaatggcactgttttaggtttagtcacttctaagtatcctcatatcaaaggtgttaatttcgacttagctcaagttttaacccaagctcctttttatccaggagtcgagcatgtatctggagacatgtttgtagaagttccaaagggagatgccgtctttatgaaatggatactacatgattggggagacgaggattgtataaagattctgaaaaattgttggaaaagtctaccggaaaaagggaagattattattgtagagtttgttacaccaaaggaaccaaagggtggtgacttatcttctaacactgtctttgccatggacttgttgatgttaacccaatgctctggtggtaaagagagatctctttcacagttcgagaatttggcgtttgcgtcaggttttcttcgatgtgaaatcatttgtcttgcttattcgtattctgttatcgaattccacaaataaatttggaatttaagaaagaaaagaaaacaatatatacgtaactttttctgttt

SEQ ID NO: 192 - protein, 381 aa, Arabidopsis thaliana
  misc_feature (1)..(381): Ceres ANNOT ID no. 869854
  misc_feature (1)..(381): Ceres GEMINI ID 5146A4
  misc_feature (1)..(381): Ceres SEED LINE ME18127
  misc_feature (111)..(358): Pfam Name: Methyltransf_2 Pfam Description: O-methyltransferase
  misc_feature (44)..(97): Pfam Name: Dimerisation Pfam Description: Dimerisation domain
  misc_feature (1)..(381): Bit score of 749 for HMM based on sequences of FIGURE 17.
MTNHLQDPLPTYPKPVLTKEEQEVDEKMVSLQAESIVNTVAFPMVLKAAFELGVIDTIAAAGNDTWLSPCEIACSLPTKPTNPEAPVLLDRMLSLLVSHSILKCRMIETGENGRTGKIERVYAAEPVCKYFLRDSDGTGSLVPLFMLLHTQVFFKTWTNLKDVILEGRDAFNSAHGMKIFEYINSDQPFAELFNRAMSEPSTMIMKKVLDVYRGFEDVNTLVDVGGGNGTVLGLVTSKYPHIKGVNFDLAQVLTQAPFYPGVEHVSGDMFVEVPKGDAVFMKWILHDWGDEDCIKILKNCWKSLPEKGKIIIVEFVTPKEPKGGDLSSNTVFAMDLLMLTQCSGGKERSLSQFENLAFASGFLRCEIICLAYSYSVIEFHK

SEQ ID NO: 193 - protein, 381 aa, Arabidopsis thaliana
  misc_feature (1)..(381): Public GI no. 27808586
  misc_feature (1)..(381): Functional Homolog of  Ceres ANNOT ID no. 869854
  misc_feature (111)..(358): Pfam Name: Methyltransf_2 Pfam Description: O-methyltransferase
  misc_feature (44)..(97): Pfam Name: Dimerisation Pfam Description: Dimerisation domain
  misc_feature (1)..(381): Bit score of 747.6 for HMM based on sequences of FIGURE 17.
MTNHLQDPLPTYPKPVLTKEEQEVDEKMVSLQAESIVNTVAFPMVLKAAFELGVIDTIAAAGNDTWLSPCEIACSLPTKPTNPEAPVLLDRMLSLLVSHSILKCRMIETGENGRTGKIERVYAAEPVCKYFLSDSDGTGSLVPLFMLLHTQVFFKTWTNLKDVILEGRDAFNSAHGMKIFEYINSDQPFAELFNRAMSEPSTMIMKKVLDVYRGFEDVNTLVDVGGGNGTVLGLVTSKYPHIKGVNFDLAQVLTQAPFYPGVEHVSGDMFVEVPKGDAVFMKWILHDWGDEDCIKILKNCWKSLPEKGKIIIVEFVTPKEPKGGDLSSNTVFAMDLLMLTQCSGGKERSLSQFENLAFASGFLRCEIICLAYSYSVIEFHK

SEQ ID NO: 194 - protein, 381 aa, Arabidopsis thaliana
  misc_feature (1)..(381): Public GI no. 15223977
  misc_feature (1)..(381): Functional Homolog of  Ceres ANNOT ID no. 869854
  misc_feature (111)..(358): Pfam Name: Methyltransf_2 Pfam Description: O-methyltransferase
  misc_feature (44)..(97): Pfam Name: Dimerisation Pfam Description: Dimerisation domain
  misc_feature (1)..(381): Bit score of 691.5 for HMM based on sequences of FIGURE 17.
MSNHLQDPLTTYPKPGLTKEEQEIDEKMVSLQAESIVNAVAFPMVLKAALELGVIDTIAAASNGTWLSPSEIAVSLPNKPTNPEAPVLLDRMLRLLVSHSILKCCMVESRENGQTGKIERVYAAEPICKYFLKDSDGSGSLSSLLLLLHSQVILKTWTNLKDVILEGKDAFSSAHDMRLFEYISSDDQFSKLFHRAMSESSTMVMKKVLEEYRGFEDVNTLVDVGGGIGTILGLITSKYPHIKGVNFDLAQVLTQAPFYPGVKHVSGDMFIEVPKGDAIFMKWILHDWGDEDCIKILKNCWKSLPEKGKVIIVEMITPMEPKPNDFSCNTVLGMDLLMLTQCSGGKERSLSQFENLAFASGFLLCEIICLSYSYSVIEFHK

SEQ ID NO: 195 - DNA, 1575 bp, Arabidopsis thaliana
  misc_feature (1)..(1575): Ceres ANNOT ID no. 870466
  misc_feature (1)..(1575): Ceres GEMINI ID 5166B2
  misc_feature (1)..(1575): Ceres SEED LINE ME20615
acttgtcagagacagaagattaaagaagaagaggcgtttctctctctttttttgcttcagaaaaaatggggtttttcttgtgttcctcttcttcaatcttcttcaagttcggaatctctataatctttctagtttctttctctggtttaactccttcagaagcttatgatcctttggacccgagtgggaacattactgtcaaatgggatatcataacctggactggagatggctatgtggcgactgtaacggtatataattttcagcaatatcgacacattcaagctccaggttggactcttggatggtcatgggcaaagagagaggttatatggggaatgaatggaggacaaaccacagaacaaggagattgttctaaattcaaaggaaccattcctcattgctgtaaaaagacaccttctgttgttgatctcttacctggatctccttacaatcagcagattgctaattgttgcagagggggtgtgcttaactcgtgggctcaagatcccgcaactgctgtttccgctttccagcttactgttggacaagctggaaccacaaataagacagttagggtacctaagaatttcactctcaaagctcctggaccgggatatacttgtagccccgcgaagattgtaaaaccgactagattcatcggtactgataaacgaagagttactcaagcattaatgacttggaatgtaacttgcacatactcgcagttcttagctcagaaaacaccaacttgctgtgtatctctttcatcgttttataacaagacaatagtttcttgtccaacatgctcttgtggatgcagaaacacttctcagccagggaattgtgtagacccaaaaggtccacggatagcatcagtcattccaaatccggggaagaacgcatatataccgcctctggtccaatgtacaaagcatatgtgtccagttagaatccactggcatgtgaaagtcaactacaaacagtactggagagttaaagtcaccatcacaaatttcaactacaacatgaactattcacagtggaatctcgtcgtgcagcatccgaatttcgacaatctaactcagacttttagcttcaactataaacctctgactccttatgcttccataaatgatactgggattctctggggaataaagttctacaatgatctgttgatgcaagctgggccatttggtaatgtacaatctgagctacttttccagaaagaagcatcagctttcacatttgagaaaggttgggcgtttccaagaagaatctatttcaatggagataactgtgtgatgcctcctcctgattcttacccttggctgcccaataccggctcgcacaaatcagtcggttccctgtttgcagcaatggccttgttactgattgtgttcctacatggaaacttgtaagaatcatcaagtgtagaattcttctgctgcagtttttcgaactgatataacccatcaagagagagttggtagcttagttttttgtgttctctcttgtctgtcctcttcctgtacaacgctttaatattagatggttaactagatccccttg

SEQ ID NO: 196 - protein, 452 aa, Arabidopsis thaliana
  misc_feature (1)..(452): Ceres ANNOT ID no. 870466
  misc_feature (1)..(452): Ceres GEMINI ID 5166B2
  misc_feature (1)..(452): Ceres SEED LINE ME20615
  misc_feature (57)..(221): Pfam Name: Phytochel_synth Pfam Description: Phytochelatin synthetase-like conserved region
  misc_feature (1)..(452): Bit score of 1219.4 for HMM based on sequences of FIGURE 8.
MGFFLCSSSSIFFKFGISIIFLVSFSGLTPSEAYDPLDPSGNITVKWDIITWTGDGYVATVTVYNFQQYRHIQAPGWTLGWSWAKREVIWGMNGGQTTEQGDCSKFKGTIPHCCKKTPSVVDLLPGSPYNQQIANCCRGGVLNSWAQDPATAVSAFQLTVGQAGTTNKTVRVPKNFTLKAPGPGYTCSPAKIVKPTRFIGTDKRRVTQALMTWNVTCTYSQFLAQKTPTCCVSLSSFYNKTIVSCPTCSCGCRNTSQPGNCVDPKGPRIASVIPNPGKNAYIPPLVQCTKHMCPVRIHWHVKVNYKQYWRVKVTITNFNYNMNYSQWNLVVQHPNFDNLTQTFSFNYKPLTPYASINDTGILWGIKFYNDLLMQAGPFGNVQSELLFQKEASAFTFEKGWAFPRRIYFNGDNCVMPPPDSYPWLPNTGSHKSVGSLFAAMALLLIVFLHGNL

SEQ ID NO: 197 - protein, 436 aa, Cleome spinosa
  misc_feature (1)..(436): Public GI no. 90657629
  misc_feature (1)..(436): Functional Homolog of  Ceres ANNOT ID no. 870466 at SEQ ID NO. 196
  misc_feature (40)..(204): Pfam Name: Phytochel_synth Pfam Description: Phytochelatin synthetase-like conserved region
  misc_feature (1)..(436): Bit score of 1170.6 for HMM based on sequences of FIGURE 8.
MAWSLDSSGLTLLQEAYDALDPDGNITIKWDIMTWTADGYVAVVTIYNFQQYRHIQAPGWSLGWTWAKREVIWGMNGGQTTEQGDCSRFKGNIPHCCKQDPTVVDLMPGTPYNQQIANCCKGGVINSFAQDPATTVSAFQLTVGQAGTTNKTVRVPKNFTLKAPGPGYTCSPGNIVKPSRFISADKRRITQALMTWNVTCTYSQFLAQKTPTCCVSLSSFYTNTIVSCPTCACGCRKTSETGTCVDPKGPRIASVIQSPGKNSYMPPLVQCTNHMCPIRIHWHVKVNYKEYWRVKISITNFNYVMNYSQWNVVVQHPNFDNLTQIFSFNYKPLTPYASINDTGILWGVKYYNDLLMQAGPSGNVQSELLFRKDPLSFTLEKGWAFPRRIYFNGDNCVMPPPDSYPRLPNFGSSLIGSRPVAVLTFLSVTAFLHRNL

SEQ ID NO: 198 - DNA, 502 bp, Gossypium hirsutum
  misc_feature (1)..(502): Ceres CLONE ID no.1883580
ataatttaaaagaaaaaaggcgttttacagtgagattaaagtgttccactacttaaactcaaagtcttaaactttcgtgtcatgtcctgttggacgaaaaagctactcatctccgttcttctctctgagtcttccctgtctgccacagatcttgaaccgaagtcaataacaaaagaagactcctaaaatcctacagaaatgtctaatctttttttgttcattgctagatctttcttcaacctaagctctttcagcgtcttgcttctgtttttgctctctttctcaagtttcactgcaacagaagcctatgatcctttggatcctaatggaaatatcacaatcaaatgggatatcatgagttggactgctgatggctatgttgcagttgtcacaatctttaacttccagcagtaccgtcacatccaagcaccagggtggacattaggttggaaatggtctaagaaggaggtgatttggagtatgatgggaggacaaacaactg

SEQ ID NO: 199 - protein, 455 aa, Gossypium hirsutum
  misc_feature (1)..(455): Ceres CLONE ID no. 1883580
  misc_feature (1)..(455): Functional Homolog of  Ceres ANNOT ID no. 870466 at SEQ ID NO. 196
  misc_feature (60)..(224): Pfam Name: Phytochel_synth Pfam Description: Phytochelatin synthetase-like conserved region
  misc_feature (1)..(455): Bit score of 1240.9 for HMM based on sequences of FIGURE 8.
MSNLFLFIARSFFNLSSFSVLLLFLLSFSSFTATEAYDPLDPNGNITIKWDIMSWTADGYVAVVTIFNFQQYRHIQAPGWTLGWKWSKKEVIWSMMGGQTTEQGDCSRFKGNIPHCCKKDPTVVDLLPGTPYNQQIANCCKGGVLNSWVQDPATAASSFQVSVGQAGTTNKTVRVPKNFTLKAPGPGYTCGPAKIVKPSRFVTADKRRVTQALMTWNVTCTYSQFLAQKTPTCCVSLSSFYNETIVPCPQCACGCQNTSQPGSCVDPKAPHIASVVPSTGKNNYAPLVQCTSHMCPVRVHWHVKLNYKEYWRVKVTITNFNYNMNYTQWNLVVQHPNFDNLTQIFSFNYKSLTPYTAINDTAMLWGVKFFNDLLSQAGQLGNVQSELLFRKDKATFTFEKGWAFARRIYFNGDNCVMPPPDAYPWLPNGSSHQLISTLSLLTTLLAAMAFLLGYA

SEQ ID NO: 200 - DNA, 1362 bp, Populus balsamifera subsp. trichocarpa
  misc_feature (1)..(1362): Ceres ANNOT ID no. 1450185
atgggctttcttgtctctcccatgatgagtttgttctcaaaattcactgtcctgctgctttttgtgctttggtgcgctagttttacttcaacagaagcctatgatcctcttgaccctactgggaatattacaatcaaatgggacatcataagctggactgctgatggctatgtcgctgttgtcacgatttacaacttccagcagtatcgtcacattcaagcaccaggatggtcactgggatggacatgggcaaagaaggaggtaatatggagcatgctgggaggccaagcaaccgaccaaggagattgttcaaaattcaaaggaaacgttccacattgttgtaaaaagagtccgacggttgtagatttattgccaggaactccttataaccagcagactgcaaattgctgcaaggggggagttatcagctcatgggcgcaagatccagccaatgcagcaagctccttccagcttagcgtgggttcagctggaaccagtaacaaaacagtgagattaccaaaaaacttcactctgaaggcaccaggacctggttatacttgtgctcgtgcaaaaattgttaagcctactagatttatgtctacagataaaaggagaatcactcaagctttgatgacatggaacgttacttgcacatattcacaattcctggctcagaagactcctagttgctgtgtctccctctcatcattctacaacgacactatagttccttgtccaaaatgcacctgtggctgccaaagaaacaattcggattcggggggttgtgttgatccaaatgcaccacatttagcttcggttgtttcgagtctagggaataacaaccctatgcctcttgtccaatgcacaagtcacatgtgcccgatcagagttcactggcatgttaagcttaactacaagcaatactggcgcgttaaggtcacaattacaaatttcaattataacatgaactatacgcaatggaacttagttgtgcaacaccccaactttgacaatctgacccagagtttcagttttaactaccagtcattatctccttattcagctattaatgatactgccatgttgtggggagtaaagttctacaatgacttgcttatgcaagccggtcgttctggtaatgttcagtcagagctactttttcgaaaggacaagtcaacttttacctttgataaaggctgggccttccctcggagaatctatttcaatggtgacaattgcgttatgcctcctccagatgcgtatccatggttgcctaatgcaagttcacgccagcttacttcaccgcttatgctaatgatagccttcttttctgttttggctttcttatatggatacgcgtag

SEQ ID NO: 201 - protein, 453 aa, Populus balsamifera subsp. trichocarpa
  misc_feature (1)..(453): Ceres ANNOT ID no. 1450185
  misc_feature (1)..(453): Functional Homolog of  Ceres ANNOT ID no. 870466 at SEQ ID NO. 196
  misc_feature (57)..(221): Pfam Name: Phytochel_synth Pfam Description: Phytochelatin synthetase-like conserved region
  misc_feature (1)..(453): Bit score of 1225.3 for HMM based on sequences of FIGURE 8.
MGFLVSPMMSLFSKFTVLLLFVLWCASFTSTEAYDPLDPTGNITIKWDIISWTADGYVAVVTIYNFQQYRHIQAPGWSLGWTWAKKEVIWSMLGGQATDQGDCSKFKGNVPHCCKKSPTVVDLLPGTPYNQQTANCCKGGVISSWAQDPANAASSFQLSVGSAGTSNKTVRLPKNFTLKAPGPGYTCARAKIVKPTRFMSTDKRRITQALMTWNVTCTYSQFLAQKTPSCCVSLSSFYNDTIVPCPKCTCGCQRNNSDSGGCVDPNAPHLASVVSSLGNNNPMPLVQCTSHMCPIRVHWHVKLNYKQYWRVKVTITNFNYNMNYTQWNLVVQHPNFDNLTQSFSFNYQSLSPYSAINDTAMLWGVKFYNDLLMQAGRSGNVQSELLFRKDKSTFTFDKGWAFPRRIYFNGDNCVMPPPDAYPWLPNASSRQLTSPLMLMIAFFSVLAFLYGYA

SEQ ID NO: 202 - protein, 458 aa, Oryza sativa subsp. japonica
  misc_feature (1)..(458): Public GI no. 50916595
  misc_feature (1)..(458): Functional Homolog of  Ceres ANNOT ID no. 870466 at SEQ ID NO. 196
  misc_feature (53)..(218): Pfam Name: Phytochel_synth Pfam Description: Phytochelatin synthetase-like conserved region
  misc_feature (1)..(458): Bit score of 1180 for HMM based on sequences of FIGURE 8.
MARFLLGAAAIALLAGVSSLLLMVPFAEAYDPLDPNGNITIKWDITQWTPDGYVAVVTIYNFQKYRHIQAPGWSLGWAWAKKEIIWSMAGGQATEQGDCSAFKANIPHCCKRDPRVVDLVPGAPYNMQFGNCCKGGVLTSWVQDPLNAVASFQITVGHSGTSNKTVKAPKNFTLKAPGPGYSCGLAQEVKPPTRFISLDGRRTTQAHVTWNVTCTYSQFVAQRAPTCCVSLSSFYNETIVNCPKCACGCQNKKPGSCVEGNSPYLASVVNGPGKGSLTPLVQCTPHMCPIRVHWHVKLNYRDYWRVKVTITNWNYRMNYSQWNLVVQHPNFENVSTVFSFNYKSLNPYGVINDTAMMWGVKYYNDLLMVAGPDGNVQSELLFRKDRSTFTFDKGWAFPRRIYFNGESCVMPSPDLYPWLPPSSTPRFRTVFLLMSFLVCGTLAFLHNHLVLDKNCGKC

SEQ ID NO: 203 - DNA, 1105 bp, Arabidopsis thaliana
  misc_feature (1)..(1105): Ceres ANNOT ID no. 887718
  misc_feature (1)..(1105): Ceres GEMINI ID 5134F7
  misc_feature (1)..(1105): Ceres SEED LINE ME18169
acttttacaactaactcataagtaaaacacagacagtttttagatggctaagatatattccccttcttttcccggtactctctgtctttgcatttttactctcttgacgctaatgttcattcgggtttccgctcgacccgcgacattcgtcgaggatttcaaagccgcctggtcggaatctcacatccgtcaaatggaagacggaaaagctatccagctcgtccttgatcagagcactggatgtggatttgcttccaaaagaaaatatctattcggacgagtgagcatgaagatcaaactcattcccggagactctgccggtacggtcaccgctttctacatgaactccgatacggccacggtgagagacgagctagattttgagttcttgggaaacagaagtggtcaaccttactcagtgcaaacaaacatatttgctcatggcaaaggagatagagaacaaagagttaatctttggttcgacccatctatggattaccacacttacactatcttatggtcacacaaacacattgttttttacgtagacgatgtgccaataagagaatacaaaaacaacgaagccaagaacatagcttacccaacatcacaacctatgggagtatactcaacattatgggaagcagatgactgggcaacacgtggtggattagagaaaattgattggagcaaagctccattttatgcttattacaaagatttcgacatcgaaggttgtcctgttcctggaccaaccttttgtccatcgaaccctcataattggtgggaaggttatgcctatcagtctcttaacgccgttgaagctcgacgttaccggtgggttagagtaaaccatatggtttatgattattgtactgaccggtctaggtttcctgtcccaccacccgagtgtcgtgcttgaaaataattgcatacgtacgttgcaatgatcatgtttcgtcttgtacgagattttatatataaattgtgggaaaatgtggattgtattgtcctcttacgcaattgtgcagacgtacgtgagtgtgtatagatataattgtgatttgtggttatttgaaatttttataaacatagatgaattctg

SEQ ID NO: 204 - protein, 292 aa, Arabidopsis thaliana
  misc_feature (1)..(292): Ceres ANNOT ID no. 887718
  misc_feature (1)..(292): Ceres GEMINI ID 5134F7
  misc_feature (1)..(292): Ceres SEED LINE ME18169
  misc_feature (240)..(290): Pfam Name: XET_C Pfam Description: Xyloglucan endo-transglycosylase (XET) C-terminus
  misc_feature (35)..(217): Pfam Name: Glyco_hydro_16 Pfam Description: Glycosyl hydrolases family 16
  misc_feature (1)..(292): Bit score of 798.7 for HMM based on sequences of FIGURE 9.
MAKIYSPSFPGTLCLCIFTLLTLMFIRVSARPATFVEDFKAAWSESHIRQMEDGKAIQLVLDQSTGCGFASKRKYLFGRVSMKIKLIPGDSAGTVTAFYMNSDTATVRDELDFEFLGNRSGQPYSVQTNIFAHGKGDREQRVNLWFDPSMDYHTYTILWSHKHIVFYVDDVPIREYKNNEAKNIAYPTSQPMGVYSTLWEADDWATRGGLEKIDWSKAPFYAYYKDFDIEGCPVPGPTFCPSNPHNWWEGYAYQSLNAVEARRYRWVRVNHMVYDYCTDRSRFPVPPPECRA

SEQ ID NO: 205 - DNA, 1193 bp, Gossypium hirsutum
  misc_feature (1)..(1193): Ceres CLONE ID no.1835843
accacaatttaatcttctaagttcaaaacattgatgacaatggcaactctaagcagtgcttttcttttcatcttctcttgtttccttgcatgttcgatctcggtttcgggacgacccgccactttcctcgaagattttagaatcacttggtccgattcccatatcaagcaaatcgatggggggagggccattcaacttattctagaccaaaattcaggctgtggatttgcttccaaaagacggtatttgtttggacgtgtcagcatgaagatcaagcttatccccggtgactcggccggaaccgtcaccgccttttacatgaattctgatacggacaccgtaagagacgagctagatttcgagttcttgggaaaccgaaccgggcaaccatacacggtccaaaccaacatatatgctcatggtaaaggtgataaagaacaaagggttaacctctggtttgatccagctgctgatttccatacatacacaattatttggaaccatcatcatattgtgttttatgtagatgaagtgccaataagagtatacaagaacaatgaagcaaaaaacatcccatacccaaaatttcaacctatgggggtatattcaacactatgggaagctgatgattgggcaacaaggggaggacttgagaaaattgattggagcaaagcaccatttttggcttattacaaggattttgacattgaagggtgtccagttccagggccagcaaattgtgctagtaaccctaggaactggtgggaaggtactgcttatcaagctcttaatgccatggaagctaggagatacaggtgggttcggatgaaccacatgatctacgattactgcaccgacaagtctcggtacccggtcaccccaccggaatgcatggcaggtatatgaagtactatcaagagttcccattgttccatatccaactgaactgtccagaatatttgatataccaatatgtttcatgtgtcatatatactttgatgtatatgcctccctttgtaccatagtagctatatgtatatgctataagagggccatgcaaaaattggggttatgaagggaaataaattgtgatcgtgtgtgcaaatatttaattttaaaacgtgtattttattattattattattgtattatccaattcagagtttgcaggccaaaaaaaaaaaaaaaaaaaa

SEQ ID NO: 206 - protein, 288 aa, Gossypium hirsutum
  misc_feature (1)..(288): Ceres CLONE ID no. 1835843
  misc_feature (1)..(288): Functional Homolog of  Ceres ANNOT ID no. 887718 at SEQ ID NO. 204
  misc_feature (234)..(284): Pfam Name: XET_C Pfam Description: Xyloglucan endo-transglycosylase (XET) C-terminus
  misc_feature (29)..(211): Pfam Name: Glyco_hydro_16 Pfam Description: Glycosyl hydrolases family 16
  misc_feature (1)..(288): Bit score of 824.8 for HMM based on sequences of FIGURE 9.
MATLSSAFLFIFSCFLACSISVSGRPATFLEDFRITWSDSHIKQIDGGRAIQLILDQNSGCGFASKRRYLFGRVSMKIKLIPGDSAGTVTAFYMNSDTDTVRDELDFEFLGNRTGQPYTVQTNIYAHGKGDKEQRVNLWFDPAADFHTYTIIWNHHHIVFYVDEVPIRVYKNNEAKNIPYPKFQPMGVYSTLWEADDWATRGGLEKIDWSKAPFLAYYKDFDIEGCPVPGPANCASNPRNWWEGTAYQALNAMEARRYRWVRMNHMIYDYCTDKSRYPVTPPECMAGI

SEQ ID NO: 207 - DNA, 885 bp, Populus balsamifera subsp. trichocarpa
  misc_feature (1)..(885): Ceres ANNOT ID no.1457442
atgaccatgtttcttcaatctctctccctgagaaaggctagtgtctttcttttcttttccttccttgcatttcctctccacgtctcggctcgaccggcaacttttcttcaagactttagagtcacatggtccgattcccatatcaggcaaatcgatggagggagggctatccaactcgttctagaccaatattcaggatgtgggttcgcatccaaggccaagtacttgttcggccgtgttagcatgaggatcaagctcatccctggagactctgctgggactgtcactgccttttatatgaattcggacaccgatgccgttcgagatgagcttgattttgaatttctggggaataggacagggcagccttacacggttcaaacaaatatctttgctcatggaaagggtgatagagaacagagagttaacctgtggtttgatcctgctgcagacttccacctctacacaattttctggaaccatcaacatattgtgttcttcgtagatgatgtgcctatcagggtttacaagaacaatgaggcgaaaggaattccatttccaaagctccagcctatgggggtatattcaacactgtgggaggccgacgattgggcaacaagaggtggcctagaaaagattaattggagcaaagcccctttctatgcatactacaaggacttcgacatcgagggatgtccggttccaggaccagcaacctgtgcttcaaatcgtggaaactggtgggaaggtgctacttaccaagccctcaacgccatggaagctaggaaatatagatgggtccgtatgaaccacatgatttatgattactgtgccgacaaatcccgttatccgactacaccaccagagtgcgttgccggtatctag

SEQ ID NO: 208 - protein, 292 aa, Populus balsamifera subsp. trichocarpa
  misc_feature (1)..(292): Ceres ANNOT ID no. 1457442
  misc_feature (1)..(292): Functional Homolog of  Ceres ANNOT ID no. 887718 at SEQ ID NO. 204
  misc_feature (238)..(288): Pfam Name: XET_C Pfam Description: Xyloglucan endo-transglycosylase (XET) C-terminus
  misc_feature (33)..(215): Pfam Name: Glyco_hydro_16 Pfam Description: Glycosyl hydrolases family 16
  misc_feature (1)..(292): Bit score of 817.8 for HMM based on sequences of FIGURE 9.
MFLQSLSLRKASVFLFFSFLAFPLHVSARPATFLQDFRVTWSDSHIRQIDGGRAIQLVLDQYSGCGFASKAKYLFGRVSMRIKLIPGDSAGTVTAFYMNSDTDAVRDELDFEFLGNRTGQPYTVQTNIFAHGKGDREQRVNLWFDPAADFHLYTIFWNHQHIVFFVDDVPIRVYKNNEAKGIPFPKLQPMGVYSTLWEADDWATRGGLEKINWSKAPFYAYYKDFDIEGCPVPGPATCASNRGNWWEGATYQALNAMEARKYRWVRMNHMIYDYCADKSRYPTTPPECVAGI

SEQ ID NO: 209 - DNA, 1101 bp, Gossypium hirsutum
  misc_feature (1)..(1101): Ceres CLONE ID no.1836342
aaaccaaactcaataatcaaaattctctcatctttctttccttatttaaagaaaagatgacaatggcattaacgaatgcttttgttttgcttttctcttgtgttcttgcaatttccttttgtgtttggggtaaaccagctacttttcttgatgattttcagattacttggtctgattcccatattaggcaaattgatggagggaaggccatccaacttgttctagaccaaaattcaggctgtggatttgcttccaaaaggaagtatttgttcggacgtgtcagcatgaagatcaagcttatacctggtgactccgccggaacagtcaccgctttttatatgaactctgatacagatacggtaagagatgagctagacttcgagttcttgggaaatcgtagcggccagccttatactgtccaaaccaatatctatgctcatggaaaaggagatagggaacaaagggttaacctttggtttgatccttctgcagatttccatacttacactattatgtggaatcatcatcatattgtcttctatgttgatgatgtgccaatccgagtttacaagaacaatgaagctagaaatataccattccctaagtttcagccaatgggagtctattcaacactgtgggaagctgatgattgggcgacaaggggaggcctggagaaaattgattggagcaaagctcctttcttagcttcctacaaggacttcgacatcgaaggatgcccagtgccaggcccagcaagctgtgcctcaaacacagggaactggtgggagggaactacttatcaagcccttaatgtcatggaagctagaaggtataggtgggttcgtataaaccacatcatctacgattactgcaccgacaaatccagatacccagttagcccaccggagtgcatcgctggcatctgaagtcctattcgaagttccacatccatttcaaatgtcatactttacgtacataccgacctcccctttgtataataatagctctacagtctatcctttgtatgcatataattgtgaagcgagaagtaggattccgagattggccccagttaatatctaaaaaaaaaaaaaaaaaaaa

SEQ ID NO: 210 - protein, 289 aa, Gossypium hirsutum
  misc_feature (1)..(289): Ceres CLONE ID no. 1836342
  misc_feature (1)..(289): Functional Homolog of  Ceres ANNOT ID no. 887718 at SEQ ID NO. 204
  misc_feature (235)..(285): Pfam Name: XET_C Pfam Description: Xyloglucan endo-transglycosylase (XET) C-terminus
  misc_feature (30)..(212): Pfam Name: Glyco_hydro_16 Pfam Description: Glycosyl hydrolases family 16
  misc_feature (1)..(289): Bit score of 789.9 for HMM based on sequences of FIGURE 9.
MTMALTNAFVLLFSCVLAISFCVWGKPATFLDDFQITWSDSHIRQIDGGKAIQLVLDQNSGCGFASKRKYLFGRVSMKIKLIPGDSAGTVTAFYMNSDTDTVRDELDFEFLGNRSGQPYTVQTNIYAHGKGDREQRVNLWFDPSADFHTYTIMWNHHHIVFYVDDVPIRVYKNNEARNIPFPKFQPMGVYSTLWEADDWATRGGLEKIDWSKAPFLASYKDFDIEGCPVPGPASCASNTGNWWEGTTYQALNVMEARRYRWVRINHIIYDYCTDKSRYPVSPPECIAGI

SEQ ID NO: 211 - protein, 294 aa, Glycine max
  misc_feature (1)..(294): Ceres CLONE ID no. 546224
  misc_feature (1)..(294): Functional Homolog of  Ceres ANNOT ID no. 887718 at SEQ ID NO. 204
  misc_feature (240)..(290): Pfam Name: XET_C Pfam Description: Xyloglucan endo-transglycosylase (XET) C-terminus
  misc_feature (35)..(217): Pfam Name: Glyco_hydro_16 Pfam Description: Glycosyl hydrolases family 16
  misc_feature (1)..(294): Bit score of 827.7 for HMM based on sequences of FIGURE 9.
MAIINTFGNVDVYILLLSSWFLVSAVCVWGRPATFLQDFEITWSKTHIRQIDQGRSIQLILDQNSGCGFASKSKYMFGRVSMKIKLIPGDSAGTVTAFYMNSDTDTVRDELDFEFLGNRSGQPYTVQTNIYAHGKGDREQRVNLWFDPSTDFHTYTIMWNHHHIVFYVDDFPIRVYKNSEGKGIPYPTMQPMGVYSTLWEADNWATRGGLEKIDWSKAPFYAYYKDFDIEGCPVPGPANCASNQSNWWEGAAYQALNAIEARRYRWVRLNHIIYDYCQDKSRFPVIPPECLAGI

SEQ ID NO: 212 - protein, 293 aa, Arabidopsis thaliana
  misc_feature (1)..(293): Ceres CLONE ID no. 142634
  misc_feature (1)..(293): Functional Homolog of  Ceres ANNOT ID no. 887718 at SEQ ID NO. 204
  misc_feature (239)..(289): Pfam Name: XET_C Pfam Description: Xyloglucan endo-transglycosylase (XET) C-terminus
  misc_feature (34)..(216): Pfam Name: Glyco_hydro_16 Pfam Description: Glycosyl hydrolases family 16
  misc_feature (1)..(293): Bit score of 712.4 for HMM based on sequences of FIGURE 9.
MVVSLFSSRNVFYTLSLCLFAALYQPVMSRPAKFEDDFRIAWSDTHITQIDGGIAIQLKLDPSSGCGFASKKQYLFGRVSMKIKLIPGDSAGTVTAFYMNSDTDSVRDELDFEFLGNRSGQPYTVQTNVFAHGKGDREQRVNLWFDPSRDFHEYAISWNHLRIVFYVDNVPIRVYKNNEARKVPYPRFQPMGVYSTLWEADDWATRGGIEKINWSRAPFYAYYKDFDIEGCPVPGPADCPANSKNWWEGSAYHQLSPVEARSYRWVRVNHMVYDYCTDKSRFPVPPPECSAGI

SEQ ID NO: 213 - protein, 287 aa, Rosa x borboniana
  misc_feature (1)..(287): Public GI no. 88604930
  misc_feature (1)..(287): Functional Homolog of  Ceres ANNOT ID no. 887718 at SEQ ID NO. 204
  misc_feature (233)..(283): Pfam Name: XET_C Pfam Description: Xyloglucan endo-transglycosylase (XET) C-terminus
  misc_feature (28)..(210): Pfam Name: Glyco_hydro_16 Pfam Description: Glycosyl hydrolases family 16
  misc_feature (1)..(287): Bit score of 805 for HMM based on sequences of FIGURE 9.
MRSSVTASISLCFLSLFSLSAFARPATFLQDFQVTWSDSHIRQIDGGRAIQLVLDQNSGCGFSSKHKYLFGRVSMKIKLIPGDSAGTVTAFYMNSDTDTVRDELDFEFLGNRTGQPYTVQTNIYARGQGNREQRVNLWFDPAADFHTYTILWNHHHIVFYVDDVPIRLYKNNEAKGIPYPKLQPMGVFSTLWEADDWATRGGLEKINWSKAPFYAYYKDFDIEGCSVPGPANCASSTNNWWEGTAYQALNALEYRRYKWVRMNHMIYDYCSDRSRFPKPPPECVAGL

SEQ ID NO: 214 - protein, 293 aa, Medicago truncatula
  misc_feature (1)..(293): Public GI no. 53653786
  misc_feature (1)..(293): Functional Homolog of  Ceres ANNOT ID no. 887718 at SEQ ID NO. 204
  misc_feature (239)..(289): Pfam Name: XET_C Pfam Description: Xyloglucan endo-transglycosylase (XET) C-terminus
  misc_feature (34)..(216): Pfam Name: Glyco_hydro_16 Pfam Description: Glycosyl hydrolases family 16
  misc_feature (1)..(293): Bit score of 820 for HMM based on sequences of FIGURE 9.
MAIFSPFKHNSVFFILLMWILLSCVFVGGRPATFNQDFHVTWSEPHIKQIDQGRTIQLTLDQGSGCGFASKVKYLFGRVSMKIKLVPGDSAGTVTAFYMNSDTDSVRDELDFEFLGNRTGQPYTVQTNIYAHGKGDREQRVNLWFDPSADFHTYSILWNHHHIVFYVDEVPIRVYKNNEAKGIPYPKMQAMGVFSTLWEADNWATRGGLEKINWSKAPFYAYYKDFDIEGCAIPGPTTCSTNPKNWWEGVEYQALSAIEARRYRWVRMNHVIYDYCQDKSRYPMTPHECLSGI

SEQ ID NO: 215 - DNA, 1053 bp, Arabidopsis thaliana
  misc_feature (1)..(1053): Ceres CLONE ID no. 1006105
  misc_feature (1)..(1053): Ceres GEMINI ID 280A7
  misc_feature (1)..(1053): Ceres SEED LINE ME04929
atcatcagaagaagaagagagctatgggaagatctccttgctgcgagaaagaacatatgaacaaaggtgcttggactaaagaagaagacgagagactagtctcttacatcaagtctcacggtgaaggttgttggcgatctcttcctagagccgctggtctccttcgctgcggtaaaagctccgtctccggtggattaactatctccgacctgatctcaaaagaggaaactttacacatgatgaagatgaacttatcatcaagcttcatagcctcctaggcaacaagtggtctttgattgcggcgagattacctggaagaacagataacgagatcaagaactactggaacacacatataaagaggaagcttttgagcaaagggattgatccagccactcatagagggatcaacgaggcaaaaatttctgatttgaagaaaacaaaggaccaaattgtaaaagatgtttcttttgtgacaaagtttgaggaaacagacaagtctggggaccagaagcaaaataagtatattcgaaatgggttagtttgcaaagaagagagagttgttgttgaagaaaaaataggcccagatttgaatcttgagcttaggatcagtccaccatggcaaaaccagagagaaatatctacttgcactgcgtcccgtttttacatggaaaacggcttgaagtgtagtagtgaaactgtgaaatgtcaaactgaggatagtagcagccttagctattcttctattgatattagtagtagtaacgttggttatgacttcttgggtttgaagacaagaattttggattttcgaagcttggaaatgaaataaatgaatagtattttagattcttaatttgtaggtgtgataatgaatgttagattcttatttttgcttcttctttttttatttttcatctttgttttccttttttccacaacatttgtatattaacttgaaattttcaatcagattaccgcaagaccttgtgttcctatgagatcgatgagcattttgatagagatccacacgtgaatttgccatcaggcatc

SEQ ID NO: 216 - protein, 84 aa, Arabidopsis thaliana
  misc_feature (1)..(84): Ceres CLONE ID no. 1006105
  misc_feature (1)..(84): Ceres GEMINI ID 280A7
  misc_feature (1)..(84): Ceres SEED LINE ME04929
  misc_feature (14)..(52): Pfam Name: Myb_DNA-binding Pfam Description: Myb-like DNA-binding domain
MGRSPCCEKEHMNKGAWTKEEDERLVSYIKSHGEGCWRSLPRAAGLLRCGKSSVSGGLTISDLISKEETLHMMKMNLSSSFIAS

SEQ ID NO: 217 - DNA, 1149 bp, Arabidopsis thaliana
  misc_feature (1)..(1149): Ceres CLONE ID no. 1014844
  misc_feature (1)..(1149): Ceres GEMINI ID 212A9
  misc_feature (1)..(1149): Ceres SEED LINE ME04199
acatctctctctatttctcttccacaaagagtcctaacttcgagttgaaacaaacaccatttctcatctctatctcagaaagaacaaaccatttcgtgttctttctttctctattctcataaggaaatataattcctgaaactgttgagttcttgtgaaaggaaataaaaaacatgatgatgggcaaagaagatctaggtttgagcctaagcttagggttttcacaaaatcacaatcctcatcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtagctggtccatcatcatcgaaccatcaccacaatcacaggccggtttcgattaacccgtggattgcttgtgctggtcaggtggctcatgggctgaattttgaagccttgcgtccacgatcgtaatttttagtggtgggggaagggtgttttgggttttttcattatcgttatatagtctatctgtgtggggtcattgtaattttggatgattggccttctcatgaactagtcaaaaaaaaaaaaaaaa

SEQ ID NO: 218 - protein, 283 aa, Arabidopsis thaliana
  misc_feature (1)..(283): Ceres CLONE ID no. 1014844
  misc_feature (1)..(283): Ceres GEMINI ID 212A9
  misc_feature (1)..(283): Ceres SEED LINE ME04199
  misc_feature (1)..(93): Pfam Name: HD-ZIP_N Pfam Description: HD-ZIP protein N terminus
  misc_feature (130)..(184): Pfam Name: Homeobox Pfam Description: Homeobox domain
  misc_feature (185)..(229): Pfam Name: HALZ Pfam Description: Homeobox associated leucine zipper
  misc_feature (1)..(283): Bit score of 866.5 for HMM based on sequences of FIGURE 10.
MMMGKEDLGLSLSLGFSQNHNPHQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVAGPSSSNHHHNHRPVSINPWIACAGQVAHGLNFEALRPRS

SEQ ID NO: 219 - protein, 283 aa, Arabidopsis thaliana
  misc_feature (1)..(283): Ceres CLONE ID no. 26013
  misc_feature (1)..(283): Functional Homolog of  Ceres CLONE ID no. 1014844 at SEQ ID NO. 218
  misc_feature (1)..(93): Pfam Name: HD-ZIP_N Pfam Description: HD-ZIP protein N terminus
  misc_feature (130)..(184): Pfam Name: Homeobox Pfam Description: Homeobox domain
  misc_feature (185)..(229): Pfam Name: HALZ Pfam Description: Homeobox associated leucine zipper
  misc_feature (1)..(283): Bit score of 865.3 for HMM based on sequences of FIGURE 10.
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVAGPSSSNHHHNHRPVSINPWIACAGQVAHGLNFEALRPRS

SEQ ID NO: 220 - protein, 274 aa, Brassica oleracea
  misc_feature (1)..(274): Public GI no. 89257493
  misc_feature (1)..(274): Functional Homolog of  Ceres CLONE ID no. 1014844 at SEQ ID NO. 218
  misc_feature (1)..(93): Pfam Name: HD-ZIP_N Pfam Description: HD-ZIP protein N terminus
  misc_feature (122)..(176): Pfam Name: Homeobox Pfam Description: Homeobox domain
  misc_feature (177)..(221): Pfam Name: HALZ Pfam Description: Homeobox associated leucine zipper
  misc_feature (1)..(274): Bit score of 830.2 for HMM based on sequences of FIGURE 10.
MMMRKEDLGLSLSLGLSQDHTPLQSQNPNSSISNNLHRFPWNQTFASTSDLGKIDVNSLPRTVDCEEEPGVSSPNSTISSTISGGKRSEREGISEHDEITPDRGYSRGNSDEEEDGGETSRKKLRLSKDQSAFLEGTFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVAGPSSNHQHNHRPVPVNPWVACAGQVTHGLNFEALRPRS

SEQ ID NO: 221 - DNA, 1132 bp, Arabidopsis thaliana
  misc_feature (1)..(1132): Ceres CLONE ID no. 108362
  misc_feature (1)..(1132): Ceres GEMINI ID 176D3
  misc_feature (1)..(1132): Ceres SEED LINE ME03210
atcatcatctctttcttcttccaaaagtcataatcatgtcaaagtctctagctggattggcggttttggccgctctttttattgctgttgatgcgtttaagccttctggtttaactaatggccacgctacattctatggaggaagtgacgcttctggaacaatgggtaatttcacactttagtttcttttatgttctgactctaaatctctaattttcttgtttttgcaggtggagcttgtgggtacggagatctttactcggcggggtacgggacaatgacggcagcgttaagcacggctctgttcaacgacggagcttcttgcggagaatgctataggataacgtgtgatcacgcggcggactcacggtggtgcttgaaaggagcttctgtggttattacagccactaacttttgcccaccaaactttgctttgcctaacaacaacggtggttggtgcaatccgccgcttaaacatttcgacatggcacaacccgcttgggaaaagatcggaatttacagaggaggaatcgttcccgtcgttttccaaagagtgagctgttacaagaaaggaggagttagattcagaataaacgggagagactacttcgagctagtgaacattcaaaatgtaggaggagcaggttctattaaatctgtatccatcaaaggatcaaagactggttggttagccatgtctcgtaattggggagctaattggcaatcgaatgcttatctagatggtcaagctctctctttctctattaccactactgatggtgctactagagtcttcctcaatgttgttccttcttcttggtcttttggacagatttattcttccaacgttcagttttaagtttttttttttgttttgtatgaaatatcattggcagtggtcgcgctttgagtctgtttcttttctccctgagcgacccgccctctttgttttttttatcttatggtatgatgggtctgttaatacaaaagacccgatatgatttgagggtatatgattatatgaagtgtattgtatttgaatgtttcagactcgaaaaagattctgtagcaaaaggagttttaacacatttgtacttggttttgtttatatgaagtttgttttagttttttc

SEQ ID NO: 222 - protein, 193 aa, Arabidopsis thaliana
  misc_feature (1)..(193): Ceres CLONE ID no. 108362
  misc_feature (1)..(193): Ceres GEMINI ID 176D3
  misc_feature (1)..(193): Ceres SEED LINE ME03210
  misc_feature (101)..(178): Pfam Name: Pollen_allerg_1 Pfam Description: Pollen allergen
  misc_feature (2)..(90): Pfam Name: DPBB_1 Pfam Description: Rare lipoprotein A (RlpA)-like double-psi beta-barrel
MTAALSTALFNDGASCGECYRITCDHAADSRWCLKGASVVITATNFCPPNFALPNNNGGWCNPPLKHFDMAQPAWEKIGIYRGGIVPVVFQRVSCYKKGGVRFRINGRDYFELVNIQNVGGAGSIKSVSIKGSKTGWLAMSRNWGANWQSNAYLDGQALSFSITTTDGATRVFLNVVPSSWSFGQIYSSNVQF

SEQ ID NO: 223 - DNA, 771 bp, Populus balsamifera subsp. trichocarpa
  misc_feature (1)..(771): Ceres ANNOT ID no.1442499
atgggaaaactgcttcttgcatttgcaatctggctgcaattctgcaactattttgctatcaatgttaatgcatttgccccatcaggatggacgaaaggtcatgctacattttatggaggcagtgatgcctcaggaactatgggaggggcttgtggatatggaaacttgtattctactggttatgggactaggactgctgctttaagcactgctttattcaatgatggagcttcatgtggagaatgctacagaattatgtgtgattttcaaacggattccagatggtgtattaaagggaggtctgtgactattactgcaacaaatttctgccccccgaattttgctcttccaaacaacaatggaggctggtgcaaccctcccctccagcatttcgatatggcccagcctgcttgggaaaagattggtatttataggggagggatcgtgcctgttttgttccaaaaggttccttgcaagaagcatggtggagtcagattcactattaatggaagaaactactttgagctcgtcttgattaccaatgtagctggagctggatccattcaatctgtgtccattaaaggctcaaaaacaggctggctggcaatgtcaagaaactggggggttaattggcaatctaatgcttatctcaatggccaatctttgtcctttaaggtcacaactactgatggacagactcgattctttacagacattgttccagcaaattgggggtttggccagactttccaaagctcagtacagttctaa

SEQ ID NO: 224 - protein, 210 aa, Populus balsamifera subsp. trichocarpa
  misc_feature (1)..(210): Ceres ANNOT ID no. 1442499
  misc_feature (1)..(210): Functional Homolog of  Ceres CLONE ID no. 108362
  misc_feature (118)..(195): Pfam Name: Pollen_allerg_1 Pfam Description: Pollen allergen
  misc_feature (19)..(107): Pfam Name: DPBB_1 Pfam Description: Rare lipoprotein A (RlpA)-like double-psi beta-barrel
MGGACGYGNLYSTGYGTRTAALSTALFNDGASCGECYRIMCDFQTDSRWCIKGRSVTITATNFCPPNFALPNNNGGWCNPPLQHFDMAQPAWEKIGIYRGGIVPVLFQKVPCKKHGGVRFTINGRNYFELVLITNVAGAGSIQSVSIKGSKTGWLAMSRNWGVNWQSNAYLNGQSLSFKVTTTDGQTRFFTDIVPANWGFGQTFQSSVQF

SEQ ID NO: 225 - DNA, 1009 bp, Arabidopsis thaliana
  misc_feature (1)..(1009): Ceres CLONE ID no. 11114
  misc_feature (1)..(1009): Ceres GEMINI ID 313A7
  misc_feature (1)..(1009): Ceres SEED LINE ME06087
catcttctaagaaagaaacaaagaaagacttcacattttaccattatttgctctgagctcagtaggagagttcaagaaacaatggcaaagatgcaattatcaatctttatcgctgtcgttgcgcttatcgtctgctctgcatctgctaaaaccgcaagccctccagctccagtgctgccaccgacaccagctccagcaccagccccggaaaatgtgaatctcaccgagcttttaagtgtagctggtccgttccacacattcctcgactaccttctctcgactggagtcattgagactttccaaaaccaagctaacaacactgaggaaggcatcacaatctttgtccctaaagatgatgctttcaaagctcagaagaatcctcctttgtcaaatctcacaaaggatcagcttaagcagcttgttctcttccatgctcttcctcattactattcgctttcggaattcaagaacttgagccaatctggtccagtgagcacctttgctggtggtcaatactccttgaaattcactgatgtttctggcacggttaggattgattctttatggaccaggactaaagtcagcagcagtgttttctccactgaccctgttgcggtttaccaattgaaccgcgtgcttctacccgaagcaatctttggtactgatgtccctccaatgcctgctccagctcctgctcctatcgttagtgctccttcggattctccttcagttgctgattctgaaggagcttcttcaccaaagtcctcacacaagaactccggacaaaagctgctacttgcaccaatctccatggttatttccggtttggtggcattgttcttgtgatcagatggttttgcagattgagttatgtttttaagttacaatgtgaaagattgtattacatcatttgaattgtctttttgatttttgaaacccattttttattatacatttttatcattattattgtttgtcattacgattttgtgaattgaaattgttcctc

SEQ ID NO: 226 - protein, 254 aa, Arabidopsis thaliana
  misc_feature (1)..(254): Ceres CLONE ID no. 11114
  misc_feature (1)..(254): Ceres GEMINI ID 313A7
  misc_feature (1)..(254): Ceres SEED LINE ME06087
  misc_feature (56)..(188): Pfam Name: Fasciclin Pfam Description: Fasciclin domain
  misc_feature (1)..(254): Bit score of 547.1 for HMM based on sequences of FIGURE 11.
MAKMQLSIFIAVVALIVCSASAKTASPPAPVLPPTPAPAPAPENVNLTELLSVAGPFHTFLDYLLSTGVIETFQNQANNTEEGITIFVPKDDAFKAQKNPPLSNLTKDQLKQLVLFHALPHYYSLSEFKNLSQSGPVSTFAGGQYSLKFTDVSGTVRIDSLWTRTKVSSSVFSTDPVAVYQLNRVLLPEAIFGTDVPPMPAPAPAPIVSAPSDSPSVADSEGASSPKSSHKNSGQKLLLAPISMVISGLVALFL

SEQ ID NO: 227 - protein, 256 aa, Glycine max
  misc_feature (1)..(256): Ceres CLONE ID no. 464185
  misc_feature (1)..(256): Functional Homolog of  Ceres CLONE ID no. 11114 at SEQ ID NO. 226
  misc_feature (53)..(185): Pfam Name: Fasciclin Pfam Description: Fasciclin domain
  misc_feature (1)..(256): Bit score of 576.7 for HMM based on sequences of FIGURE 11.
MEFSMIFIVSNIMLLFSSAFAKTASPPSLSPTPAPAPAPDFVNLTELLSVAGPFHTFLGYLESTKVIDTFQNQANNTEEGITIFVPKDSAFNAIKKTTLSNLTSNQLKQVILFHALPHFYSLAEFTSLSQTSSTPTFAGGDYTLNFTDDSGTVHINSGWSKTRVSSAVHSTDPVAIYQVDKVLLPEAIFGTDIPPAPAPAPTPDIAPAADSPTEHSADSKASSPSSTHDGSSSHKLISYGIWANLVLATFGVLVLF

SEQ ID NO: 228 - DNA, 771 bp, Populus x canescens; identical to SEQ ID NO: 223
  misc_feature (1)..(771): Ceres ANNOT ID no.47717927

SEQ ID NO: 229 - protein, 262 aa, Populus x canescens
  misc_feature (1)..(262): Public GI no. 47717927
  misc_feature (1)..(262): Functional Homolog of  Ceres CLONE ID no. 11114 at SEQ ID NO. 226
  misc_feature (58)..(191): Pfam Name: Fasciclin Pfam Description: Fasciclin domain
  misc_feature (1)..(262): Bit score of 611 for HMM based on sequences of FIGURE 11.
MEFSMIIVLCSTLLFSCTPLAYAQKVASPPAPTPTPSPAPAPSPPYVNLTDLLSVAGPFQNFLNYLESTKVIDTFQNQANNTDEGITIFVPKDDAFKNLKKPSLSNLTQDQLKQLILFHALPHYYSLSDFKNLSQVSPVSTFAGAGRYALNFTDTSGTVQLDSGWSKTKVSSSVHSTDPVAVYQVDKVLLPEAIFGTDIPPTPAPAPAPDTSPAADSPTSDDSAGAGSAPGKSTPNSSYRINGVGIWSQLVLAIAGVLVLFL

SEQ ID NO: 230 - DNA, 792 bp, Populus balsamifera subsp. trichocarpa
  misc_feature (1)..(792): Ceres ANNOT ID no.1498092
atggagttttccatgattattatgtttagtagcacgctgttgtttttgtgcactccagtagcatatgctcaaacggcagctagtcctccagcaccaaccccaactccgtcctcatcaccagcaccagcaccaacacctccttacgttagcctcactgatttgctctctgttgctggcccattccacaccttccttagctaccttgaatccactaaggtcgttgacaccttccaaaaccaagccaacaacactgatgaaggcattaccatcttcgtaccaaaagatgatgccttcaaaaatcttaagaagccttctttgtcaaacctaactcaagaccaggtgaagcaactcattcttttccatgccttgccgcactattacgccttggctgatttcaagaaccttagccaagtaagccctgttagcacatttgctggtgcaggcggatatgctttgaatttcacagatgtatctgggaccgtgcaccttgattcaggatggtcaaaaaccaaagttagcagtagtgtgcattcaactgatcccgttgcagtttatcaagttgacaaagtcctccttcctgaggcgatatttggtgctgatatacctccagccccagccccagccccagcccctgaaaccagccttgctgcagattctccatcatctgacagtactggagatgggagcgctccaggaacttcccctccaaattcttcttataggatctttggtgtagatatttggagtcaattggttttggcactcataggtgtgctggtcctgttcttgtag

SEQ ID NO: 231 - protein, 263 aa, Populus balsamifera subsp. trichocarpa
  misc_feature (1)..(263): Ceres ANNOT ID no. 1498092
  misc_feature (1)..(263): Functional Homolog of  Ceres CLONE ID no. 11114 at SEQ ID NO. 226
  misc_feature (60)..(193): Pfam Name: Fasciclin Pfam Description: Fasciclin domain
  misc_feature (1)..(263): Bit score of 592.3 for HMM based on sequences of FIGURE 11.
MEFSMIIMFSSTLLFLCTPVAYAQTAASPPAPTPTPSSSPAPAPTPPYVSLTDLLSVAGPFHTFLSYLESTKVVDTFQNQANNTDEGITIFVPKDDAFKNLKKPSLSNLTQDQVKQLILFHALPHYYALADFKNLSQVSPVSTFAGAGGYALNFTDVSGTVHLDSGWSKTKVSSSVHSTDPVAVYQVDKVLLPEAIFGADIPPAPAPAPAPETSLAADSPSSDSTGDGSAPGTSPPNSSYRIFGVDIWSQLVLALIGVLVLFL

SEQ ID NO: 232 - DNA, 789 bp, Populus balsamifera subsp. trichocarpa
  misc_feature (1)..(789): Ceres ANNOT ID no. 1472093
atgaagttttctatgattattgtgcttagcagcacactgctgttttcgtgcactccactagcatatgctcaaaaagtagctagtcctccagcaccaaccccaactccatccccagcaccagcaccatcacctccttacgttaacctcactgatttactctctgttgctggcccattccacaacttccttaactaccttgagtccactaaagtcattgacacctttcaaaaccaagccaacaacactgatgaaggcattaccatcttcgtaccaaaagatgatgccttcaaaaatctcaagaaggcttctttgtcaaacctaactcaagaccagctcaagcaactcattctttttcatgccttgccacattattactcgttgtctgatttcaagaaccttagccaagtgagccctgtcagcacatttgctggtgcaggaggatatgctttgaatttcaccgatacatctgggaccgtgcaccttgattcaggatggtctaaaactaaagttagtagtagtgtgcattcaactgatcctgttgcaatctatcaagttgacaaagtcctccttcctgaggcaatctttggtactaatatacctccaaccccagctccagcaccagctcctgacactagccctactgcagattccccaacatctgacgactcagcaggagcagggagcgccccaggaaagtcccccccaaattcttcttataggatcaatggtgtaggtatttggagtcaattggttctagctattgcaggtgtgctggtcctgtttttgtaa

SEQ ID NO: 233 - protein, 262 aa, Populus balsamifera subsp. trichocarpa
  misc_feature (1)..(262): Ceres ANNOT ID no. 1472093
  misc_feature (1)..(262): Functional Homolog of  Ceres CLONE ID no. 11114 at SEQ ID NO. 226
  misc_feature (58)..(191): Pfam Name: Fasciclin Pfam Description: Fasciclin domain
  misc_feature (1)..(262): Bit score of 601.9 for HMM based on sequences of FIGURE 11.
MKFSMIIVLSSTLLFSCTPLAYAQKVASPPAPTPTPSPAPAPSPPYVNLTDLLSVAGPFHNFLNYLESTKVIDTFQNQANNTDEGITIFVPKDDAFKNLKKASLSNLTQDQLKQLILFHALPHYYSLSDFKNLSQVSPVSTFAGAGGYALNFTDTSGTVHLDSGWSKTKVSSSVHSTDPVAIYQVDKVLLPEAIFGTNIPPTPAPAPAPDTSPTADSPTSDDSAGAGSAPGKSPPNSSYRINGVGIWSQLVLAIAGVLVLFL

SEQ ID NO: 234 - protein, 262 aa, Medicago truncatula
  misc_feature (1)..(262): Public GI no. 92870641
  misc_feature (1)..(262): Functional Homolog of  Ceres CLONE ID no. 11114 at SEQ ID NO. 226
  misc_feature (58)..(190): Pfam Name: Fasciclin Pfam Description: Fasciclin domain
  misc_feature (1)..(262): Bit score of 571.4 for HMM based on sequences of FIGURE 11.
MKVSMIFLVSTLLLLSSSAFAKTVSPPSPPAESPTPAPAPAPTPDFVNLTELLTVAGPFHTFLQYLQSTKVLDTFQNQANNTEEGITIFVPKDSSFASLKKPSLSKLKDDEIKQVILFHALPHFYSLADFKNLSQTASTPTFAGGDYTLNFTDNSGTVKINSGWSITKVTSAVHATDPVAIYQVDKVLLPEAIFGTDIPPVLAPAPTPEIAPAADSPTEQSADSKSSSPSSSPDRSSSYKIVSYGIWGNLVLATFGLVVVIL

SEQ ID NO: 235 - protein, 269 aa, Zea mays
  misc_feature (1)..(269): Ceres CLONE ID no. 1277160
  misc_feature (1)..(269): Functional Homolog of  Ceres CLONE ID no. 11114 at SEQ ID NO. 226
  misc_feature (64)..(197): Pfam Name: Fasciclin Pfam Description: Fasciclin domain
  misc_feature (1)..(269): Bit score of 579.8 for HMM based on sequences of FIGURE 11.
MEFKAGVFTVAMLAIVVLSTPAAPQKPKSPPAPRSPVVLAPAPAPAPAAPHHVDLADLLSVAGPFHTFLDYLQKTGVIETFQSQANDTKRGGITVFVPKDSAFAALKQTTFANLTQDQLRSLLLCHALPKYYSLAEFDRLSALGPVATLAGSQYTLNLTYDMGTVRVKSMWSDPKISSSVYSTRPVAVYEVGKVLLPMQIFKSDPPLAPAPAPAPDAKASDVAPSPASGKSSASAKAKEKAGEKSSSCRAGVVAHYLAIAVSGGLVLLW

SEQ ID NO: 236 - protein, 263 aa, Gossypium hirsutum
  misc_feature (1)..(263): Public GI no. 606942
  misc_feature (1)..(263): Functional Homolog of  Ceres CLONE ID no. 11114 at SEQ ID NO. 226
  misc_feature (57)..(189): Pfam Name: Fasciclin Pfam Description: Fasciclin domain
  misc_feature (1)..(263): Bit score of 566.1 for HMM based on sequences of FIGURE 11.
MEFSMIFMISFSVLILCSSLAYGQVAMSTNPTPSPSPAPAPTPAYTNIKDLLSVAGPYHKFLGYLESTKLIDTFQIQANNTVEGITIFVPKDSAFKALTKPSLSNLTDDQFKSVLLYHALPRYYALADFNDLSEKGPISTLAGGQYTLQFNDESGTVRLDSGWSKTKVTSAVHTSKPVAVYQIDKVLLPEAIFGTDIPPTPAPAPALGIGPSADTPSAAKSEETGSSSKPSFSGSSSPRIMMNSGIWTQLVLAFLGGWLVLFF

SEQ ID NO: 237 - protein, 261 aa, Brachypodium sylvaticum
  misc_feature (1)..(261): Public GI no. 86438624
  misc_feature (1)..(261): Functional Homolog of  Ceres CLONE ID no. 11114 at SEQ ID NO. 226
  misc_feature (61)..(193): Pfam Name: Fasciclin Pfam Description: Fasciclin domain
  misc_feature (1)..(261): Bit score of 549.1 for HMM based on sequences of FIGURE 11.
MELKGAIFTTAVLATLLCSPALAQKSPPAPASVALPPTMAPAPAPAPDYVDLAALLGVAGPFHTFLSYLQKTNVIETFQRQANKTKEGITIFVPKDSAFAALKKSTFSNLTSDQLKTLLLYHAFPEFYSLAQFRNLSVLNPVNTFAGAPYTLNLTDDMGTISVKSMWSKPTISSSVYATDPVAVYSLNKVLLPMQIFTKDPPLAPAPAPAPESGASDLAPSPGGKAGAGKGKADSTSAAYGIGVGAVNCLLAAGGLMMLLW

SEQ ID NO: 238 - protein, 274 aa, Oryza sativa subsp. japonica
  misc_feature (1)..(274): Public GI no. 50947359
  misc_feature (1)..(274): Functional Homolog of  Ceres CLONE ID no. 11114 at SEQ ID NO. 226
  misc_feature (63)..(196): Pfam Name: Fasciclin Pfam Description: Fasciclin domain
  misc_feature (1)..(274): Bit score of 548.3 for HMM based on sequences of FIGURE 11.
MMESKAAMMVTILLCCSSISPAFAQKHKGPPAAAAVSLPPSPAPSPAAPRHVDLADLLSVAGPFHTFLDLLEKTDVLRTFQSQANGSKDGITVFVPKDAAFASLARSATANLTSDQLKSLALYHALPRYYSLAEFNRLGGAASPVPTLAGGEYTVNVTDDMGTVHVGSMWSNPKISSSVYSTRPVAVYEVDRVLLPMQIFRTDPPMAPSPAPAPDAKPASDAASPLPGKSSSAKAKADEKKSSSSPPSSRRGAGIAGYFLALAASASAGLLLLC

SEQ ID NO: 239 - DNA, 1597 bp, Arabidopsis thaliana
  misc_feature (1)..(1597): Ceres CLONE ID no. 114130
  misc_feature (1)..(1597): Ceres GEMINI ID 280F9
  misc_feature (1)..(1597): Ceres SEED LINE ME04941
agatcaaactcaaaacaaaatttgtttgttcgtttgatctttcttaaaaatatgaaaattaacatcagagattccaccatggtccggcctgccaccgagacaccaatcactaatctttggaactccaacgttgatcttgtcatccccagattccatacccctagtgtctacttctacagacccaccggcgcttccaatttctttgaccctcaggtcatgaaggaagctctttccaaagcccttgtccctttttaccctatggctggtcgcttgaagagagacgatgatggtcgtattgagatcgattgtaacggtgccggtgttctcttcgttgttgctgatactccttctgttatcgatgattttggtgattttgctcctacccttaatctccgtcagcttattcccgaagttgatcactccaccggcattcactctttcccgcttctcgttttgcaggtgactttctttaaatgtgggggagcttcacttggggttgggatgcaacatcacgcggcagatggtttctctggtcttcattttatcaacacatggtctgatatggctcgtggtcttgacctaaccattccacctttcattgatcgaacactcctccgagctagggacccgccacagcctgcttttcatcatgttgaatatcagcctgcaccaagtatgaagatccctcttgatccatccaaatcaggacctgagaataccaccgtgtctatattcaaattaacacgagaccagcttgttgctctcaaagcgaaatccaaggaggatgggaacactgtcagctatagctcatatgagatgttggcaggccatgtgtggagatcagtgggaaaggcgcgagggcttccaaacgaccaagagacgaaactgtacattgcaactgatggaaggtctagactgcgtccgcagctgcctcctggttactttgggaatgtgatattcactgcaacaccattggctgttgcaggggatctgctatctaaaccaacatggtatgctgcaggacagattcatgatttcttggttcgtatggatgataactatctgaggtcagctcttgactacctggagatgcagcctgatctgtcagcccttgtccgcggtgcacatacctacaagtgtccaaatttaggaatcacaagctgggtcagattacctatttatgatgcagactttggttggggtcgtcctatctttatgggacctggtggaattccgtatgagggtttgtcgtttgtgctaccaagtcctactaatgatggcagcttatccgttgccattgccctccaatctgaacacatgaaactgtttgagaagtttttgtttgagatatgagagcgttaagccctcgtttttccctcagtaaatttgggcaaatttgcttcttgtcatcatcctgtgttttagagggtacaacaaatcataaggtgtgcttatggtctgtaactttggactatgtcgtataggaacttttgctttatgttaatacagatgataagtgttgttctatgacacatgccgtgattgctttgtgtttgatttgttatatccaccatgctgtatgattttcagcttccat

SEQ ID NO: 240 - protein, 433 aa, Arabidopsis thaliana
  misc_feature (1)..(433): Ceres CLONE ID no. 114130
  misc_feature (1)..(433): Ceres GEMINI ID 280F9
  misc_feature (1)..(433): Ceres SEED LINE ME04941
  misc_feature (1)..(433): Pfam Name: Transferase Pfam Description: Transferase family
  misc_feature (1)..(433): Bit score of 1146.2 for HMM based on sequences of FIGURE 12.
MKINIRDSTMVRPATETPITNLWNSNVDLVIPRFHTPSVYFYRPTGASNFFDPQVMKEALSKALVPFYPMAGRLKRDDDGRIEIDCNGAGVLFVVADTPSVIDDFGDFAPTLNLRQLIPEVDHSTGIHSFPLLVLQVTFFKCGGASLGVGMQHHAADGFSGLHFINTWSDMARGLDLTIPPFIDRTLLRARDPPQPAFHHVEYQPAPSMKIPLDPSKSGPENTTVSIFKLTRDQLVALKAKSKEDGNTVSYSSYEMLAGHVWRSVGKARGLPNDQETKLYIATDGRSRLRPQLPPGYFGNVIFTATPLAVAGDLLSKPTWYAAGQIHDFLVRMDDNYLRSALDYLEMQPDLSALVRGAHTYKCPNLGITSWVRLPIYDADFGWGRPIFMGPGGIPYEGLSFVLPSPTNDGSLSVAIALQSEHMKLFEKFLFEI

SEQ ID NO: 241 - DNA, 1380 bp, Gossypium hirsutum
  misc_feature (1)..(1382): Ceres CLONE ID no.1920088
agtgctcaccacctttttcaccaactcctctcccgttttcttgctctttttcttcctttgcatttacttctgatttgtaggttccttttttccgattcccttgagtaatcaagctttttgtttatttgttttactttctgggttttccatcctgtttcattgcttgcttatattctatatgtatatattcttcaatagccatggttatttgagttggaattctgaatgcactggaacacttttttttctcttaaaaaaaaactcagagaccagagaaggtatcaaatcctaccgaggaaaggcgattatctgttgatttcaatttcaaaatatctatttttcttatactctgtgtgtgtgtggtacatggaactaagtatatggtttcgttttttctggagaaagatgaattggtggtgttgatgttattagtttaatattcaataatacattgaatcaggcaaaaagcaaaccaatccttttccccccagtggatcccaccagcactacaaccatgattgtgaatgtgaaagaatcaacaatggtaaggccggcgggggagactccccggcggagcctctggaacgccaacgtggacttggtggtaccaaggttccacacccctagcgtttacttctacaggccgaacggagcggccaatttcttcgatccgcaggtgatgaaggaggcgttgagcaaggccctggtgccattttaccccatggcggggcggctgaagagggacgaggatggaaggatcgagatcgattgcaatggcgaaggggtgctctttgttgaggctgaaactaattctgttattgacgattttggtgattttgcacccaccttggagctcaggcagctcatcccaaccgttgattattccggtggcatctccacgtatccactcttggttttgcaggtcacatatttcaaatgtggtggagcatcactaggtgttggcatgcaacatcatgcagcagatggatattctggtcttcacttcatcaacacatggtctgatatggctcgtggtcttgaccttacaattccaccattcattgatcggacccttcttcgtgcccgggaccccccacaacctgtgtttcaccacatcgaatatcaaccaccaccggcaatgaagattccacccgtgtccaccggttctgaaagcacagaagtctccattttcaaattgacccgggatcaactcaatgcactcaaagcaaagtgcaaggaagatggtaacgatgttaactatagttcatacgagatgttgccaggtcatgtgtggagatcagtctgcaaggcacgtggacttgaagatgatcaagggactaaactgtacaattgccactgatggaagggcaaggttgcgcc

SEQ ID NO: 242 - protein, 431 aa, Gossypium hirsutum
  misc_feature (1)..(431): Ceres CLONE ID no. 1920088
  misc_feature (1)..(431): Functional Homolog of  Ceres CLONE ID no. 114130 at SEQ ID NO. 240
  misc_feature (1)..(431): Pfam Name: Transferase Pfam Description: Transferase family
  misc_feature (1)..(431): Pfam Name: Transferase Pfam Description: Transferase family
  misc_feature (1)..(431): Bit score of 1166.9 for HMM based on sequences of FIGURE 12.
MIVNVKESTMVRPAGETPRRSLWNANVDLVVPRFHTPSVYFYRPNGAANFFDPQVMKEALSKALVPFYPMAGRLKRDEDGRIEIDCNGEGVLFVEAETNSVIDDFGDFAPTLELRQLIPTVDYSGGISTYPLLVLQVTYFKCGGASLGVGMQHHAADGYSGLHFINTWSDMARGLDLTIPPFIDRTLLRARDPPQPVFHHIEYQPPPAMKIPPVSTGSESTEVSIFKLTRDQLNALKAKCKEDGNDVNYSSYEMLSGHVWRSVCKARGLEDDQGTKLYIATDGRARLRPPLPPGYFGNVIFTATPIAVAGDLLSKPTWYAASRIHDALVRMDDEYLRSALDYLEFQPDLSALVRGAHTFRCPNLGITSWVRLPIHDADFGWGRPIFMGPGGIPYEGLSFVLPSPNNDGSLSVAISLQTEHMKVFEKLFYDI

SEQ ID NO: 243 - DNA, 991 bp, Gossypium hirsutum
  misc_feature (1)..(991): Ceres CLONE ID no.1920450
agtgctcaccacctttttcaccaactcctctcccgtttttttgttcttcttcttcctttgcatttacttctgatttgcaggccaaaagcaaaccaatccttttccccccagtggatcccaccagcactacaaccatgattgtgaacgtgaaagaatcaacaatggtacggccggcgggggagactccccggcggagcctctggaacgccaacgtggacttggtggtaccaaggttccacacccctagcgtttacttctacaggccgaacggagcggccaatttcttcgatccgcaggtgatgaaggaggcgttgagcaaggccctggtgccgttttaccccatggcggggcggctgaagagggacgaggatggaaggatcgagattgattgcaatggcgaaggggtgctctttgttgaggctgaaactaattctgttattgacgattttggtgattttgcacccaccttggagctcaggcagctcatcccaaccgttgattattccggtggcatctccacgtatccactcttggttttgcaggtcacatatttcaaatgtggtggagcatcactaggtgttggcatgcaacatcatgcagcagatggatattctggtctccacttcatcaacacatggtctgatatggttcgtggtcttgaccttacaattccaccattcattgatcggacccttcttcgtgcccgggaccccccacaacctgtgttccaccacgtcgaatatcaaccaccaccggcaatgaagattccaccccagtccaccggtcctgaaagcacagcaatctccattttcaaattgacccgggatcaactcaatgcactcaaagcaaagtgcaaggaagatggtaacgatgttaactatagttcatacgagatgttgtcaggtcatgtgtggagatcagtctgcaaggcacgtggacttgaagatgatcaagggactaaactgtacattgccactgatggaagggcaag

SEQ ID NO: 244 - protein, 431 aa, Gossypium hirsutum
  misc_feature (1)..(431): Ceres CLONE ID no. 1920450
  misc_feature (1)..(431): Functional Homolog of  Ceres CLONE ID no. 114130 at SEQ ID NO. 240
  misc_feature (1)..(431): Pfam Name: Transferase Pfam Description: Transferase family
  misc_feature (1)..(431): Pfam Name: Transferase Pfam Description: Transferase family
  misc_feature (1)..(431): Bit score of 1165.9 for HMM based on sequences of FIGURE 12.
MIVNVKESTMVRPAGETPRRSLWNANVDLVVPRFHTPSVYFYRPNGAANFFDPQVMKEALSKALVPFYPMAGRLKRDEDGRIEIDCNGEGVLFVEAETNSVIDDFGDFAPTLELRQLIPTVDYSGGISTYPLLVLQVTYFKCGGASLGVGMQHHAADGYSGLHFINTWSDMVRGLDLTIPPFIDRTLLRARDPPQPVFHHVEYQPPPAMKIPPQSTGPESTAISIFKLTRDQLNALKAKCKEDGNDVNYSSYEMLSGHVWRSVCKARGLEDDQGTKLYIATDGRARLRPPLPPGYFGNVIFTATPIAVAGDLLSKPTWYAASRIHDALVRMDDEYLRSALDYLELQPDLSALVRGAHTFRCPNLGITSWVRLPIHDADFGWGRPIFMGPGGIPYEGLSFVIPSPNNDGSLSVAISLQTEHMKVFEKLFYDI

SEQ ID NO: 245 - DNA, 691 bp, Gossypium hirsutum
  misc_feature (1)..(691): Ceres CLONE ID no.1941995
gcaacattgaatttgaaactgaaacttagttggcattcattttgtaggccaaaagcaaaccaatccttttccccccagtggatcccaccagcactacaaccatgattgtgaacgtgaaagaatcaacaatggtacggccggcgggggagactccccggcggagcctctggaacgccaacgtggacttggtggtaccaaggttccacacccctagcgtttacttctacaggccgaacggagcggccaatttcttcgatccgcaggtgatgaaggaggcgttgagcaaggccctggtgccgttttaccccatggcggggcggctgaagagggacgaggatggaaggatcgagattgattgcaatggcgaaggggtgctctttgttgaggctgaaactaattctgttattgacgattttggtgattttgcacccaccttggagctcaggcagctcatcccaaccgttgattattccggtggcatctccacgtatccactcttggttttgcaggtcacatatttcaaatgtggtggagcatcactaggtgttggcatgcaacatcatgcagcagatggatattctggtctccacttcatcaacacatggtctgatatggttcgtggtcttgaccttacaattccaccattcattgatcggacccttcttcgtgcccgggaccccccacaacctgt

SEQ ID NO: 246 - protein, 431 aa, Gossypium hirsutum; identical to SEQ ID NO: 244
  misc_feature (1)..(431): Ceres CLONE ID no. 1941995
  misc_feature (1)..(431): Functional Homolog of  Ceres CLONE ID no. 114130 at SEQ ID NO. 240
  misc_feature (1)..(431): Pfam Name: Transferase Pfam Description: Transferase family
  misc_feature (1)..(431): Pfam Name: Transferase Pfam Description: Transferase family
  misc_feature (1)..(431): Bit score of 1165.9 for HMM based on sequences of FIGURE 12.

SEQ ID NO: 247 - DNA, 1887 bp, Gossypium hirsutum
  misc_feature (1)..(1887): Ceres CLONE ID no.1920870
agtgctcaccacctttttcaccaactcctctcccgttttcttgctctttttcttcctttgcatttacttctgatttgtaggttccttttttccgattcccttgagtaatcaagctttttgtttatttgttttactttctgggttttccatcctgtttcattgcttgcttatattctatatgtatatattcttcaatagccatggttatttaagttggaattctgaatgcactggaacacttttttttctcttaaaaaaaaaactcagagaccagagaaggcaaaaagcaaaccaatccttttccccccagtggatcccaccagcactacaaccatgattgtgaatgtgaaagaatcaacaatggtaaggccggcgggggagactccccggcggagcctctggaacgccaacgtggacttggtggtaccaaggttccacacccctagcgtttacttctacaggccgaacggagcggccaatttcttcgatccgcaggtgatgaaggaggcgttgagcaaggccctggtgccattttaccccatggcggggcggctgaagagggacgaggatggaaggatcgagatcgattgcaatggcgaaggggtgctctttgttgaggctgaaactaattctgttattgacgatkttggtgattttgcacccaccttggagctcaggcagctcatcccraccgttgattattccggtggcatctccacgtrtccactctkggttttgcagggcacatatttcaaatgtggtggagcatcactaggtgttggcatgcaacatcatgcagcagatggatattctggtcttcacttcatcaacacatggtctgatatggctcgtggtcttgaccttacaattccaccattcattgatcggacccttcttcgtgcccgggaccccccacaacctgtgtttcaccacatcgaatatcaaccaccaccggcaatgaagattccacccgtgtccaccggttctgaaagcacagaagtctccattttcaaattgacccgggatcaactcaatgcactcaaagcaaagtgcaaggaagatggtaacgatgttaactatagttcatacgagatgttgtcaggtcatgtgtggagatcagtctgcaaggcacgtggacttgaagatgatcaagggactaaactgtacattgccactgatggaagggcaaggttgcgccccccactcccacctggttactttgggaatgtgatcttcactgctaccccaatagcagtggcaggggatctactgtcaaagccaacatggtacgctgcgagccgtattcatgatgcattggttcggatggatgatgaatatctaaggtcagcccttgattacctggaatttcagccagatttgtctgcacttgtacgtggtgctcatactttcaggtctccgaaccttgggattactagctgggttaggctaccaatccatgatgcagatttcgggtggggcaggcccatatttatgggccctggtggaattccttatgaagggttatctttcgtattaccaagtccaaacaatgatgggagcttatcagttgccatctccttgcaacccgaacacatgaaagtgtttgagaagctcttttatgacatttaaaggaagaggaaacctcgtatacagtccatgtagtctttaaacgttcctttttcccaatttttttaatacttgtttatgttataaagtctcacattcacttgaaatgtacctcaaattcagacttcactggtcacaagccatatgcttgtgcatagaaaaaagaaaaactttggacaagttgtattactaatttcggttcaatatcgatgttgttgtattactaatttcggttcaatatcgatgttgttgaatattgtg

SEQ ID NO: 248 - protein, 431 aa, Gossypium hirsutum
  misc_feature (1)..(431): Ceres CLONE ID no. 1920870
  misc_feature (1)..(431): Functional Homolog of  Ceres CLONE ID no. 114130 at SEQ ID NO. 240
  misc_feature (1)..(431): Pfam Name: Transferase Pfam Description: Transferase family
  misc_feature (1)..(431): Pfam Name: Transferase Pfam Description: Transferase family
  misc_feature (1)..(431): Bit score of 1163.7 for HMM based on sequences of FIGURE 12.
MIVNVKESTMVRPAGETPRRSLWNANVDLVVPRFHTPSVYFYRPNGAANFFDPQVMKEALSKALVPFYPMAGRLKRDEDGRIEIDCNGEGVLFVEAETNSVIDDFGDFAPTLELRQLIPTVDYSGGISTYPLLVLQVTYFKCGGASLGVGMQHHAADGYSGLHFINTWSDMARGLDLTIPPFIDRTLLRARDPPQPVFHHIEYQPPPAMKIPPVSTGSESTEVSIFKLTRDQLNALKAKCKEDGNDVNYSSYEMLSGHVWRSVCKARGLEDDQGTKLYIATDGRARLRPPLPPGYFGNVIFTATPIAVAGDLLSKPTWYAASRIHDALVRMDDEYLRSALDYLEFQPDLSALVRGAHTFRSPNLGITSWVRLPIHDADFGWGRPIFMGPGGIPYEGLSFVLPSPNNDGSLSVAISLQTEHMKVFEKLFYDI

SEQ ID NO: 249 - DNA, 1275 bp, Populus balsamifera subsp. trichocarpa
  misc_feature (1)..(1275): Ceres ANNOT ID no.1448109
atggtgcagccggcagaggagacgccccggagggggctgtggaattctaatgtggacctggtggtaccaagattccacaccccgagtgtctacttttataggcccacaggtgcctcaaacttctttgatgcaaaagtgctcaaagaggctttgagtaaggcccttgtaccattctaccctatggcagggcggttacgtagagatgatgatggccgcatcgagatcgattgcaatgctgagggagtgttgtttgttgaagctgggaccgcctcagttgttgctgattttggtgattttgcacccactttagagctcaagcagcttattccaactgtggattactctggcgggatatctacttatcctcttttggttttgcaggtgacctatttcaaatgcggaggagtttcacttggtgttggtatgcaacaccatgcagcggatgggttttctggtctccactttgtgaatacatggtcagatatggctcgtggtcttgaccttacaattccacccttcattgacaggacccttctccgtgccagagacccaccccaacctgcattccaccacgttgagtaccagcctccacctgccatgaaaactgttcttgaaacctcaaaaccagagagcacagcggtctccatttttaagttgaccagggatcagctcaacaccctcaaagccaaagcaaaggaaggtggaaacaatattggttatagttcatatgaaatgttggcgggtcacgtatggagatcagcatgtaaggcacgcggacttcctgatgatcaagaaaccaagttatatatagctacagatggtcggtcaagactgcgccctacgcttccacctggttactttggcaatgtaatctttacagcaacaccaattgctgtagcaggtgaaattcaatcaaagccaacatggtatgctgcaggaaaaattcatgattcattggttcgcatggacaatgattatctaaggtcagcccttgatttcctagagcttcagcctgatttatcagcccttgttcgcggcgcccatactttccggtgcccaaatcttgggattactagctgggttagactgccaatccatgatgcagattttggctggggaagacctatatttatggggcctggtgggatcgcatacgagggcttatcattcatcataccaagctcaacaaatgacgggagcttgtcagtagccatatctttgcaagctgaacacatgaaactatttgagaagtttatatatgacattaaagaatga

SEQ ID NO: 250 - protein, 424 aa, Populus balsamifera subsp. trichocarpa
  misc_feature (1)..(424): Ceres ANNOT ID no. 1448109
  misc_feature (1)..(424): Functional Homolog of  Ceres CLONE ID no. 114130 at SEQ ID NO. 240
  misc_feature (1)..(422): Pfam Name: Transferase Pfam Description: Transferase family
  misc_feature (1)..(424): Bit score of 1138.4 for HMM based on sequences of FIGURE 12.
MVQPAEETPRRGLWNSNVDLVVPRFHTPSVYFYRPTGASNFFDAKVLKEALSKALVPFYPMAGRLRRDDDGRIEIDCNAEGVLFVEAGTASVVADFGDFAPTLELKQLIPTVDYSGGISTYPLLVLQVTYFKCGGVSLGVGMQHHAADGFSGLHFVNTWSDMARGLDLTIPPFIDRTLLRARDPPQPAFHHVEYQPPPAMKTVLETSKPESTAVSIFKLTRDQLNTLKAKAKEGGNNIGYSSYEMLAGHVWRSACKARGLPDDQETKLYIATDGRSRLRPTLPPGYFGNVIFTATPIAVAGEIQSKPTWYAAGKIHDSLVRMDNDYLRSALDFLELQPDLSALVRGAHTFRCPNLGITSWVRLPIHDADFGWGRPIFMGPGGIAYEGLSFIIPSSTNDGSLSVAISLQAEHMKLFEKFIYDIKE

SEQ ID NO: 251 - DNA, 1302 bp, Populus balsamifera subsp. trichocarpa
  misc_feature (1)..(1302): Ceres ANNOT ID no.1501106
atgataatcaatttgaaggaatcaaccatggtgcagccggcagaggagacgccccggagggggctgtggaattctaatgtggacctggtggtaccaagattccacaccccgagtgtctacttttataggcccacaggtgcctcaaacttctttgatgcaaaagtgctcaaagaggctttgagtaaggcccttgtaccattctaccctatggcagggcggttacgtagagatgatgatggccgcatcgagatcgattgcaatgctgagggagtgttgtttgttgaagctgggaccgcctcagttgttgctgattttggtgattttgcacccactttagagctcaagcagcttattccaactgtggattactctggcgggatatctacttatcctcttttggttttgcaggtgacctatttcaaatgcggaggagtttcacttggtgttggtatgcaacaccatgcagcggatgggttttctggtctccactttgtgaatacatggtcagatatggctcgtggtcttgaccttacaattccacccttcattgacaggacccttctccgtgccagagacccaccccaacctgcattccaccacgttgagtaccagcctccacctgccatgaaaactgttcttgaaacctcaaaaccagagagcacagcggtctccatttttaagttgaccagggatcagctcaacaccctcaaagccaaagcaaaggaaggtggaaacaatattggttatagttcatatgaaatgttggcgggtcacgtatggagatcagcatgtaaggcacgcggacttcctgatgatcaagaaaccaagttatatatagctacagatggtcggtcaagactgcgccctacgcttccacctggttactttggcaatgtaatctttacagcaacaccaattgctgtagcaggtgaaattcaatcaaagccaacatggtatgctgcaggaaaaattcatgattcattggttcgcatggacaatgattatctaaggtcagcccttgatttcctagagcttcagcctgatttatcagcccttgttcgcggcgcccatactttccggtgcccaaatcttgggattactagctgggttagactgccaatccatgatgcagattttggctggggaagacctatatttatggggcctggtgggatcgcatacgagggcttatcattcatcataccaagctcaacaaatgacgggagcttgtcagtagccatatctttgcaagctgaacacatgaaactatttgagaagtttatatatgacattaaagaatga

SEQ ID NO: 252 - protein, 433 aa, Populus balsamifera subsp. trichocarpa
  misc_feature (1)..(433): Ceres ANNOT ID no. 1501106
  misc_feature (1)..(433): Functional Homolog of  Ceres CLONE ID no. 114130 at SEQ ID NO. 240
  misc_feature (1)..(431): Pfam Name: Transferase Pfam Description: Transferase family
  misc_feature (1)..(431): Pfam Name: Transferase Pfam Description: Transferase family
  misc_feature (1)..(433): Bit score of 1171.8 for HMM based on sequences of FIGURE 12.
MIINLKESTMVQPAEETPRRGLWNSNVDLVVPRFHTPSVYFYRPTGASNFFDAKVLKEALSKALVPFYPMAGRLRRDDDGRIEIDCNAEGVLFVEAGTASVVADFGDFAPTLELKQLIPTVDYSGGISTYPLLVLQVTYFKCGGVSLGVGMQHHAADGFSGLHFVNTWSDMARGLDLTIPPFIDRTLLRARDPPQPAFHHVEYQPPPAMKTVLETSKPESTAVSIFKLTRDQLNTLKAKAKEGGNNIGYSSYEMLAGHVWRSACKARGLPDDQETKLYIATDGRSRLRPTLPPGYFGNVIFTATPIAVAGEIQSKPTWYAAGKIHDSLVRMDNDYLRSALDFLELQPDLSALVRGAHTFRCPNLGITSWVRLPIHDADFGWGRPIFMGPGGIAYEGLSFIIPSSTNDGSLSVAISLQAEHMKLFEKFIYDIKE

SEQ ID NO: 253 - DNA, 1260 bp, Populus balsamifera subsp. trichocarpa
  misc_feature (1)..(1269): Ceres ANNOT ID no.1483635
atggtgcagccggcggaggagacgccccggagggggctgtggaattctaatgtggacttggtggtaccaaggttccacaccccaagtgtctatttttataggcccacaggtgctccaaacttctttgatgcaaaagtgctcaaaggggctttgagtaaggcccttgtgccattctaccccatggcaggacggttacgtagagatgaggatggtcgcattgaaattaattgcaatgctgagggagtgttgtttgttgaggctgagaccacctcagttatagatgattttgctgattttgcacccactttggagctcaagcagctcatacctactgtggattactctggcgggatatctacctatcctcttttggttctgcaggtgacttatttcaaatgcggaggagtttcacttggtgttggtatgcaacaccatgcagcggatgggttttctggtcttcacttcgtgaacacatggtcagatatggctcgtggacttgaccttaccattccacccttcattgacaggacccttctccgtgccagagatccacctcaacctgtattccaccacgttgagtaccagcctccaccgtccatgaaaaccgttcttgaaacctcaaaaccagagagcacggcggtctccatttttaagttgtctagggatcagctcagcaccctcaaagccaaagcaaaggaagatggaaacaatattagttatagttcatatgagatgttggcggctcatgtgtggagatcaacatgcaaagcacgtgaacttcctgatgatcaagagaccaagttatatattgccacagatggtcggtcaagatggcaacctcaactccctcctggttactttggcaatgtgatctttacagcaacaccaattgctgtagctggtgaaatgcaatcaaagccaacatggtatgctgcaggaaaaattcatgatgcattggttcgcatggataacgattatttaaagtcagcccttgattatctagagcttcagcctgacttgtcagcccttgttcgtggtgcccatagtttccggtgcccaaatcttgggattactagctgggttagactgccaatccacgatgcagattttggctggggcagacccatattcatggggcctggtgggatcgcatacgagggcttatcattcatcctacccagcccaacaaatgatgggagcatgtcagtagccatatctttgcaagctcaacatatgaaactatttgagaagttcatatat

SEQ ID NO: 254 - protein, 422 aa, Populus balsamifera subsp. trichocarpa
  misc_feature (1)..(422): Ceres ANNOT ID no. 1483635
  misc_feature (1)..(422): Functional Homolog of  Ceres CLONE ID no. 114130 at SEQ ID NO. 240
  misc_feature (1)..(422): Pfam Name: Transferase Pfam Description: Transferase family
  misc_feature (1)..(422): Bit score of 1120 for HMM based on sequences of FIGURE 12.
MVQPAEETPRRGLWNSNVDLVVPRFHTPSVYFYRPTGAPNFFDAKVLKGALSKALVPFYPMAGRLRRDEDGRIEINCNAEGVLFVEAETTSVIDDFADFAPTLELKQLIPTVDYSGGISTYPLLVLQVTYFKCGGVSLGVGMQHHAADGFSGLHFVNTWSDMARGLDLTIPPFIDRTLLRARDPPQPVFHHVEYQPPPSMKTVLETSKPESTAVSIFKLSRDQLSTLKAKAKEDGNNISYSSYEMLAAHVWRSTCKARELPDDQETKLYIATDGRSRWQPQLPPGYFGNVIFTATPIAVAGEMQSKPTWYAAGKIHDALVRMDNDYLKSALDYLELQPDLSALVRGAHSFRCPNLGITSWVRLPIHDADFGWGRPIFMGPGGIAYEGLSFILPSPTNDGSMSVAISLQAQHMKLFEKFIYDI

SEQ ID NO: 255 - DNA, 1296 bp, Populus balsamifera subsp. trichocarpa
  misc_feature (1)..(1296): Ceres ANNOT ID no.1537107
atgataatcaacgtgaaggagtcaaccatggtgcagccggcggaggagacgccccggagggggctgtggaattctaatgtggacttggtggtaccaaggttccacaccccaagtgtctatttttataggcccacaggtgctccaaacttctttgatgcaaaagtgctcaaaggggctttgagtaaggcccttgtgccattctaccccatggcaggacggttacgtagagatgaggatggtcgcattgaaattaattgcaatgctgagggagtgttgtttgttgaggctgagaccacctcagttatagatgattttgctgattttgcacccactttggagctcaagcagctcatacctactgtggattactctggcgggatatctacctatcctcttttggttctgcaggtgacttatttcaaatgcggaggagtttcacttggtgttggtatgcaacaccatgcagcggatgggttttctggtcttcacttcgtgaacacatggtcagatatggctcgtggacttgaccttaccattccacccttcattgacaggacccttctccgtgccagagatccacctcaacctgtattccaccacgttgagtaccagcctccaccgtccatgaaaaccgttcttgaaacctcaaaaccagagagcacggcggtctccatttttaagttgtctagggatcagctcagcaccctcaaagccaaagcaaaggaagatggaaacaatattagttatagttcatatgagatgttggcggctcatgtgtggagatcaacatgcaaagcacgtgaacttcctgatgatcaagagaccaagttatatattgccacagatggtcggtcaagatggcaacctcaactccctcctggttactttggcaatgtgatctttacagcaacaccaattgctgtagctggtgaaatgcaatcaaagccaacatggtatgctgcaggaaaaattcatgatgcattggttcgcatggataacgattatttaaagtcagcccttgattatctagagcttcagcctgacttgtcagcccttgttcgtggtgcccatagtttccggtgcccaaatcttgggattactagctgggttagactgccaatccacgatgcagattttggctggggcagacccatattcatggggcctggtgggatcgcatacgagggcttatcattcatcctacccagcccaacaaatgatgggagcatgtcagtagccatatctttgcaagctcaacatatgaaactatttgagaagttcatatatgacatttaa

SEQ ID NO: 256 - protein, 431 aa, Populus balsamifera subsp. trichocarpa
  misc_feature (1)..(431): Ceres ANNOT ID no. 1537107
  misc_feature (1)..(431): Functional Homolog of  Ceres CLONE ID no. 114130 at SEQ ID NO. 240
  misc_feature (1)..(431): Pfam Name: Transferase Pfam Description: Transferase family
  misc_feature (1)..(431): Pfam Name: Transferase Pfam Description: Transferase family
  misc_feature (1)..(431): Bit score of 1156 for HMM based on sequences of FIGURE 12.
MIINVKESTMVQPAEETPRRGLWNSNVDLVVPRFHTPSVYFYRPTGAPNFFDAKVLKGALSKALVPFYPMAGRLRRDEDGRIEINCNAEGVLFVEAETTSVIDDFADFAPTLELKQLIPTVDYSGGISTYPLLVLQVTYFKCGGVSLGVGMQHHAADGFSGLHFVNTWSDMARGLDLTIPPFIDRTLLRARDPPQPVFHHVEYQPPPSMKTVLETSKPESTAVSIFKLSRDQLSTLKAKAKEDGNNISYSSYEMLAAHVWRSTCKARELPDDQETKLYIATDGRSRWQPQLPPGYFGNVIFTATPIAVAGEMQSKPTWYAAGKIHDALVRMDNDYLKSALDYLELQPDLSALVRGAHSFRCPNLGITSWVRLPIHDADFGWGRPIFMGPGGIAYEGLSFILPSPTNDGSMSVAISLQAQHMKLFEKFIYDI

SEQ ID NO: 257 - protein, 438 aa, Prunus mume
  misc_feature (1)..(438): Public GI no. 82568711
  misc_feature (1)..(438): Functional Homolog of  Ceres CLONE ID no. 114130 at SEQ ID NO. 240
  misc_feature (3)..(438): Pfam Name: Transferase Pfam Description: Transferase family
  misc_feature (3)..(438): Pfam Name: Transferase Pfam Description: Transferase family
  misc_feature (1)..(438): Bit score of 1147.7 for HMM based on sequences of FIGURE 12.
MVVNVSVRETTLVKPAAETPRKALWNSNVDLVIPSIHTPSVYFYRPNQNGASSNFFDPAVLKLALSKALVPFYPMAGRLKRDDDGRIEIDCNGEGVLFVEAETSSVIDDFGDFAPTLELRRLIPAVDYSAGISSYALLVLQVTYFKCGGVSLGVGMQHHAADGFSGLHFVNTWSDMARGLDLTLPPFIDRTLLRARDPPQPAFHHIEYQPAPPLKTPLQSTKPGADSTTVSIFRLTREQLNILKAKSKEAGNTISYSSYEMMAGHIWRCVCKARELPNDQDTKLYIATDGRSRLQPPLPPGYFGNVIFTATPIAVAGDLQSKPTWFAASRIHDSLVRMDDNYLRSALDYLELQPDLSALVRGAHSFRCPNLGITSWVRLPIHDADFGWGRPIFMGPGGIAFEGLAFVIPSATNDGSLSVAISLQSEHMKSFSKLLYDI

SEQ ID NO: 258 - protein, 435 aa, Nicotiana tabacum
  misc_feature (1)..(435): Public GI no. 27475616
  misc_feature (1)..(435): Functional Homolog of  Ceres CLONE ID no. 114130 at SEQ ID NO. 240
  misc_feature (1)..(435): Pfam Name: Transferase Pfam Description: Transferase family
  misc_feature (1)..(435): Pfam Name: Transferase Pfam Description: Transferase family
  misc_feature (1)..(435): Bit score of 1165.8 for HMM based on sequences of FIGURE 12.
MKIEVKESTMVKPAAETPQQRLWNSNVDLVVPNFHTPSVYFYRPTGSPNFFDGKVLKEALSKALVPFYPMAGRLCRDEDGRIEIDCKGQGVLFVEAESDGVVDDFGDFAPTLELRQLIPAVDYSQGIQSYALLVLQITHFKCGGVSLGVGMQHHAADGASGLHFINTWSDMARGLDLTIPPFIDRTLLRARDPPQPQFPHVEYQPPPTLKVTPENTPISEAVPETSVSIFKLTRDQINTLKAKSKEDGNTVNYSSYEMLAGHVWRSTCMARGLAHDQETKLYIATDGRSRLRPSLPPGYFGNVIFTTTPIAVAGDIQSKPIWYAASKLHDALARMDNDYLRSALDYLELQPDLKALVRGAHTFKCPNLGITSWSRLPIHDADFGWGRPIFMGPGGIAYEGLSFILPSPTNDGSQSVAISLQAEHMKLFEKFLYDF

SEQ ID NO: 259 - protein, 429 aa, Glycine max
  misc_feature (1)..(429): Ceres CLONE ID no. 660782
  misc_feature (1)..(429): Functional Homolog of  Ceres CLONE ID no. 114130 at SEQ ID NO. 240
  misc_feature (1)..(429): Pfam Name: Transferase Pfam Description: Transferase family
  misc_feature (1)..(429): Bit score of 1138.6 for HMM based on sequences of FIGURE 12.
MMINVKESTMVRPAEEVARRVVWNSNVDLVVPNFHTPSVYFYRSNGAPNFFDGKVMKEALTKVLVPFYPMAGRLLRDDDGRVEIDCDGQGVLFVEADTGAVIDDFGDFAPTLELRQLIPAVDYSQGIASYPLLVLQVTHFKCGGVSLGVGMQHHVADGASGLHFINTWSDVARGLDVSIPPFIDRTILRARDPPRPIFDHIEYKPPPAMKTQQATNASAAVSIFRLTRDQLNTLKAKSKEDGNTISYSSYEMLAGHVWRSVSKARALPDDQETKLYIATDGRSRLQPPTPPGYFGNVIFTTTPIAVAGDLMSKPTWYAASRIHNALLRMDNDYLRSALDYLELQPDLKALVRGAHTFKCPNLGITSWTRLPIHDADFGWGRPIFMGPGGIAYEGLSFIIPSSTNDGSLSVAIALQPDHMKLFKDFLYDI

SEQ ID NO: 260 - protein, 438 aa, Glycine max
  misc_feature (1)..(438): Ceres CLONE ID no. 1620792
  misc_feature (1)..(438): Functional Homolog of  Ceres CLONE ID no. 114130 at SEQ ID NO. 240
  misc_feature (1)..(438): Pfam Name: Transferase Pfam Description: Transferase family
  misc_feature (1)..(438): Bit score of 1131.9 for HMM based on sequences of FIGURE 12.
MIINVKESTVVRPAEEVARRVVWNSNVDLVVPNFHTPSVYFYRSNGTSNFFDGKVLKEALSKVLVPFYPMAGRLRRDEDGRVEIDCDGQGVLFVEADTGAVIDDFGDFAPTLELRQLIPAVDYSQGIETYPLLVLQVTHFKCGGVSLGVGMQHHVADGASGLHFINTWSDVARGLDVSIPPFIDRTILRARDPPRPVFDHIEYKPPPAMKTQQPTKPGSDSDNAAAAAAVSIFRLTREQLNTLKAKSKEDGNTISYSSYEMLAGHVWRSVCKARVLPDDQETKLYIATDGRSRLQPPPPPGYFGNVIFTTTPIAVAGDLMSKPTWYAASRIHNALLRMDNDYLRSALDYLELQPDLKALVRGAHTFKCPNLGITSWTRLPIHDADFGWGRPIFMGPGGIAYEGLSFIIPSSTNDGSLSVAIALQPDHMKVFKDFLYDI

SEQ ID NO: 261 - protein, 439 aa, Glycine max
  misc_feature (1)..(439): Ceres CLONE ID no. 566887
  misc_feature (1)..(439): Functional Homolog of  Ceres CLONE ID no. 114130 at SEQ ID NO. 240
  misc_feature (1)..(438): Pfam Name: Transferase Pfam Description: Transferase family
  misc_feature (1)..(439): Bit score of 1070.9 for HMM based on sequences of FIGURE 12.
MLINVKQSTMVRPAEETPRRALWNSNVDLVVPNFHTPSVYFYRPNGVSNFFDAKVMKEALSKVLVPFYPMAARLRRDDDGRVEIYCDAQGVLFVEAETTAAIEDFGDFSPTLELRQLIPSVDYSAGIHSYPLLVLQVTYFKCGGVSLGVGMQHHVADGASGLHFINAWSDVARGLDISLPPFIDRTLLRARDPPLPVFDHIEYKPPPATKKTTPLQPSKPLGSDSTAVAVSTFKLTRDQLSTLKGKSREDGNTISYSSYEMLAGHVWRSVCKARALPDDQETKLYIATDGRARLQPPLPHGYFGNVIFTTTRIAVAGDLMSKPTWYAASRIHDALIRMDNEYLRSALDYLELQPDLKSLVRGAHTFRCPNFGITSWARLPIHDADFGWGRPIFMGPGGIAYEGLSFIIPSSTNDGSLSLAIALPPEQMKVFQELFYDDI

SEQ ID NO: 262 - protein, 442 aa, Oryza sativa subsp. japonica
  misc_feature (1)..(442): Public GI no. 50926145
  misc_feature (1)..(442): Functional Homolog of  Ceres CLONE ID no. 114130 at SEQ ID NO. 240
  misc_feature (1)..(442): Pfam Name: Transferase Pfam Description: Transferase family
  misc_feature (1)..(442): Bit score of 1122.3 for HMM based on sequences of FIGURE 12.
MAITVRRSTMVRPAWETPRVRLWNSNLDLVVPRFHTPSVYFYRRGPEGGGAPEGFFDGERMRRALAEALVPFYPMAGRLARDEDGRVEIDCNGEGVLFVEADAPDASVDDYGDFAPTMELKRLIPAVDYTDDISSFSLLVLQVTYFKCGGVSLGVGMQHHVADGMSGLHFINSWSDLCRGTQIAIMPFIDRTLLRARDPPTPSYPHVEYQPAPAMLSSVPQSVTANKTTPPPTAVDIFKLTRSDLGRLRSQLPSGEGAPRFSTYAVLAAHVWRCVSLARGLPSEQPTKLYCATDGRQRLQPPLPEGYFGNVIFTATPLAEAGKVTSGLADGAAVIQEALDRMNDSYCRSALDYLELQPDLSALVRGAHTFRCPNLGLTSWVRLPIHDADFGWGRPVFMGPGGIAYEGLAFVLPSANKDGSLSIAISLQAEHMEKFRKLIFEV

SEQ ID NO: 263 - protein, 442 aa, Zea mays
  misc_feature (1)..(442): Ceres CLONE ID no. 465877
  misc_feature (1)..(442): Functional Homolog of  Ceres CLONE ID no. 114130 at SEQ ID NO. 240
  misc_feature (1)..(440): Pfam Name: Transferase Pfam Description: Transferase family
  misc_feature (1)..(442): Bit score of 1111.8 for HMM based on sequences of FIGURE 12.
MAITVRRSTMVRPARETPRQRLWNSNLDLVVPRFHTPSVYFYRRDGPVPDAEGFFDGERMRRALAEALVPFYPMAGRLARDEDGRVEIDCNGEGVLFVEADAPDASVDDYGDFAPTMELKRLIPTVDYTDDISAFSLLVLQVTYFKCGGVSLGVGMQHHAADGMSGLHFINSWSDLCRGAQISVMPFIDRTLLRARDPPTPSFQHIEYQPAPAMLSSTTQFLASKSKPPATAVDIFKLTRSDLGRLRSQLPAGEGAPRFSTYAVLAAHVWKCVSLARSLPPEQPTKLYCATDGRQRLQPPLPDGYFGNVIFTATPLAEAGKVTSELAEGAAVIQGALDRMDNDYCRSALDYLDLQPDLSALVRGAHTFRCPNLGLTSWVRLPIHDADFGWGRPVFMGPGGIAYEGLAFVLPSANGDGSLSIAISLQAEHMEKFRKLIGGANC

SEQ ID NO: 264 - protein, 442 aa, Oryza sativa subsp. japonica
  misc_feature (1)..(442): Public GI no. 50910387
  misc_feature (1)..(442): Functional Homolog of  Ceres CLONE ID no. 114130 at SEQ ID NO. 240
  misc_feature (1)..(442): Pfam Name: Transferase Pfam Description: Transferase family
  misc_feature (1)..(442): Bit score of 1085 for HMM based on sequences of FIGURE 12.
MKINVRGSTMVRPAEETPRVRLWNSSLDLVVPRFHTPSVYFFRRGEAAAAEGGSYFDGERMRRALAEALVPFYPMAGRLAHDEDGRVEIDCNGEGVLFVEADAPGATVDDFGDFAPTMDLKRLIPTVDYTDGISSFPILVLQVTHFKCGGVALGVGMQHHVADGFSGLHFINSWADLCRGVPIAVMPFIDRTLVRARDPPAPSHPHVEYQPAPAMLAPEPPQALTAKPAPPPTAVDIFKLSRSDLGRLRSQLPRGEGAPRYSTYAVLAAHVWRCASLARGLPAEQPTKLYCATDGRQRLQPSLPDGYFGNVIFTATPLAEAGRVTGSLADGAATIQSALDRMDSGYCRSALDYLELQPDLSALVRGAHTFRCPNLGLTSWVRLPIHDADFGWGRPVFMGPGGIAYEGLAFVLPSASGDGSLSVAISLQAEHMEKFRKMIFDF

SEQ ID NO: 265 - protein, 447 aa, Zea mays
  misc_feature (1)..(447): Ceres CLONE ID no. 1598714
  misc_feature (1)..(447): Functional Homolog of  Ceres CLONE ID no. 114130 at SEQ ID NO. 240
  misc_feature (1)..(447): Pfam Name: Transferase Pfam Description: Transferase family
  misc_feature (1)..(447): Bit score of 1085.9 for HMM based on sequences of FIGURE 12.
MKITVRGSEMVYPAAETPRRRLWNSGPDLVVPRFHTPSVYFFRREDADGNDLAGADGSFFDGARMRRALAEALVPFYPMAGRLARDEDGRVEIDCNAGGVLFQEADAPDATIDYFGDFAPTMELKRLIPTVDFTDDISSFPLLVLQVTHFKCGGVAIGVGMQHHVADGFSGLHFINSWADLCRGVPIAVMPFIDRSLLRARDPPTPAYPHIEYQPAPAMLSSEPPQAALTSKPATPPTAVAIFKLSRAELVRLRSQVPAREGAPRFSTYAVLAAHVWRCASLARGLPADQPTKLYCATDGRQRLQPPLPEGYFGNVIFTATPLANAGTVTAGVAEGASVIQAALDRMDDGYCRSALDYLELQPDLSALVRGAHTFRCPNLGLTSWVRLPIHDADFGWGRPVFMGPGGIAYEGLAFVLPSANRDGSLSVAISLQAEHMEKFRKLIYDF

SEQ ID NO: 266 - protein, 447 aa, Zea mays; identical to SEQ ID NO: 265
  misc_feature (1)..(447): Ceres CLONE ID no. 1691303
  misc_feature (1)..(447): Functional Homolog of  Ceres CLONE ID no. 114130 at SEQ ID NO. 240
  misc_feature (1)..(447): Pfam Name: Transferase Pfam Description: Transferase family
  misc_feature (1)..(447): Bit score of 1085.9 for HMM based on sequences of FIGURE 12.

SEQ ID NO: 267 - protein, 440 aa, Avena sativa
  misc_feature (1)..(440): Public GI no. 32400295
  misc_feature (1)..(440): Functional Homolog of  Ceres CLONE ID no. 114130 at SEQ ID NO. 240
  misc_feature (1)..(440): Pfam Name: Transferase Pfam Description: Transferase family
  misc_feature (1)..(440): Bit score of 1096.9 for HMM based on sequences of FIGURE 12.
MKITVRSSTVVVPAAETPRVRLWNANPDLVVPRFHTPSVYFYRRGGDGDACCYFDAARMRRALAEALVPFYPMAGRLAHDEDGRVEIDCNAEGVLFVEADAPDGAVDDFGDFAPTMGLKRLIPTVDFTGGISSYPLLVVQVTHFKCGGVALGIGMQHHVADGFSGLHFINSWSDLCRGVPIAVMPFIDRTLLRARDPPVPTHPHIEYQPAPAMLGSEEPQALAGKPESPPTAVDIFKLSRSDLGRLRAQLPTGEGAPRFSTYAVLGAHVWRCASLARGLAPEQPTKLYCATDGRQRLTPTLPDGYFGNVIFTATPLAEAGKVTGSLADGATTIQDALEKMDDEYCHSALDYLELQPDLSALVRGAHTFRCPNLGLTSWVRLPIHDADFGWGRPVFMGPGGIAYEGLAFVLPSANRDGSLSVAISLQAEHMEKFRKMIFDF

SEQ ID NO: 268 - protein, 442 aa, Triticum aestivum
  misc_feature (1)..(442): Ceres CLONE ID no. 741711
  misc_feature (1)..(442): Functional Homolog of  Ceres CLONE ID no. 114130 at SEQ ID NO. 240
  misc_feature (1)..(442): Pfam Name: Transferase Pfam Description: Transferase family
  misc_feature (1)..(442): Bit score of 1098.6 for HMM based on sequences of FIGURE 12.
MKITVRGSTVVVPAEETPRLRLWNANPDLVVPRFHTPSVYFFRRGAGEGEEAGRYFDAERMRRALAEALVPFYPMAGRLARDEDGRVEIDCNAEGVLFVEADAPDGTVDDFGDFAPTMDLKRLIPAVDFTGGISSYPLLVVQVTHFKCGGVALGIGMQHHVADGFSGLHFINSWADLCRGVPIAIMPFIDRTLLRARDPPTPSHPHIEYQPAPAMLDSEEPQALTAKPEAPPTAVDIFKLSRADLGRLRAQLPTGEGAPRFSTYAVLGAHVWRCASLARGLSPEQPTKLYCATDGRQRLQPPLPEGYFGNVIFTATPLAVAGKVTGSLADGATTIQAALEVMDNEYCRSALDYLEMQPDLSALVRGAHTFRCPNLGLTSWVRLPIHDADFGWGRPVFMGPGGIAYEGLAFVLPSASRDGSLSVAISLQAEHMEKFRKMIFDF

SEQ ID NO: 269 - DNA, 1812 bp, Panicum virgatum
  misc_feature (1)..(1812): Ceres CLONE ID no.1795778
agctctccaccaagagctaataccagtatacccgccgccgcccgccccaccagcacctaacgccccccgcctgctttacagtttacaccgcgtcccgcgccgccgccgccgcgttgggttgcgtcccagatccgccgagctcttcgactggtcgctcgagcaagatgaagatcacggtgcgggggtcggagatggtgtacccggcggcggcgacgccgcggcggcggctgtggaactcgggcccggacctggtggtgccgcggttccacacgcccagcgtctacttcttccgccgcagggacggcgagggcaacgacctggcggccgcggacgggagcttcttcgacggcgcccggatgcggcgcgcgctggcggaggcgctggtgcccttctacccgatggcggggcggctggcgcgcgacgaggacgggcgcgtggagatcgactgcaacgccggcggggtgctgttccaggaggcggacgcgcccgacgccaccgtcgacgacttcggcgacttcgcgcccaccatggagctcaagcgcctcatccccaccgtcgagtacaccgacgacatctccgccttcccgctcctcgtgctccaggtgacacacttcaaatgcggtggcgtggcgatcggcgtgggcatgcagcaccacgtcgccgatggcttctccggcctgcacttcatcaactcgtgggcggacctctgccgcggcatcccgatcgccgtcatgccctacattgaccgctccctcctccgcgcgcgcgacccgccgaccccagtgtacccacacatcgagtaccagccggcgcccgccatgctgtccgagccgccgcaggcgcccctcacggccaagccggcgacgccgcccaccgctgtggccatcttcaggctcagccgcgccgaccttggccgcctccgctcgcagatccccgcgcgcgagggcgcgccgcggttcagcacgtacgcggtcctggcggcgcacgtgtggcggtgcgcgtccctggcgcgcggcctccccgcggaccagcccaccaagctgtactgcgccacggacgggcggcagcggctgcagccgccgctccccgagggctacttcggcaacgtgatcttcactgctacaccgctggcggacgccggcacggtgacggccggggtggcggagggcgcggccgtgatccaggcggcgctggaccggatggacgacgggtactgccggtcggcgctggactacctggagctgcagccggacctgtcggcgctggtccgcggcgcgcacacgttccggtgccccaacctggggctcactagctgggtgcggctgcccatccacgacgcggacttcgggtgggggcggcccgtgttcatgggccccggcggcatcgcgtacgaggggcttgcgttcgtgctccccagctccaaccgcgacggcagcctgtccgtggccatctcgctgcaggccgagcacatggagaagttccggaaattcatctacgacttctgatcgcctcgacacccaagtcatcggcgagcgcaggcgcggtagaagcaagcagagaagcgctaggcagatgcccagcacaggacagggagggtgatcttactaggttacagcaagattctttgattgcacacatagttcctgcacacttaattttttttccccgttcctgcctgccccctttcgggcgggatatatacttgtgcgtatgattcacgggcctgaacggcctgaacaaattgtaatatgaacaatttaatccgttctgagtgatacaggttaataaggtcaaaaaaaaaaaaaaaaaaaa

SEQ ID NO: 270 - protein, 446 aa, Panicum virgatum
  misc_feature (1)..(446): Ceres CLONE ID no. 1795778
  misc_feature (1)..(446): Functional Homolog of  Ceres CLONE ID no. 114130 at SEQ ID NO. 240
  misc_feature (1)..(446): Pfam Name: Transferase Pfam Description: Transferase family
  misc_feature (1)..(446): Bit score of 1092 for HMM based on sequences of FIGURE 12.
MKITVRGSEMVYPAAATPRRRLWNSGPDLVVPRFHTPSVYFFRRRDGEGNDLAAADGSFFDGARMRRALAEALVPFYPMAGRLARDEDGRVEIDCNAGGVLFQEADAPDATVDDFGDFAPTMELKRLIPTVEYTDDISAFPLLVLQVTHFKCGGVAIGVGMQHHVADGFSGLHFINSWADLCRGIPIAVMPYIDRSLLRARDPPTPVYPHIEYQPAPAMLSEPPQAPLTAKPATPPTAVAIFRLSRADLGRLRSQIPAREGAPRFSTYAVLAAHVWRCASLARGLPADQPTKLYCATDGRQRLQPPLPEGYFGNVIFTATPLADAGTVTAGVAEGAAVIQAALDRMDDGYCRSALDYLELQPDLSALVRGAHTFRCPNLGLTSWVRLPIHDADFGWGRPVFMGPGGIAYEGLAFVLPSSNRDGSLSVAISLQAEHMEKFRKFIYDF

SEQ ID NO: 271 - protein, 441 aa, Avena sativa
  misc_feature (1)..(441): Public GI no. 32400291
  misc_feature (1)..(441): Functional Homolog of  Ceres CLONE ID no. 114130 at SEQ ID NO. 240
  misc_feature (1)..(441): Pfam Name: Transferase Pfam Description: Transferase family
  misc_feature (1)..(441): Bit score of 1084 for HMM based on sequences of FIGURE 12.
MKITVRSSTVVVPAAETPRVRLWNANPDLVVPRFHTPSVYFYRRGGEDGGDACYFDAGRMRRALAEALVPFYPMAGRLAHDEDGRVEIDCNAEGVLFVEADAPDGAVDDFGDFVPTMGLKRLIPTVDFTGGISSYPLLVVQVTHFKCGGVALGIAMQHHVADGFSGLHFINSWSDLCRGVPIAVMPFIDRTLLRARDPPVPTHPHIEYQPAPAMLGSEEPQALAGKPESPPTAVDIFKLSRSDLGRLRAQLPTGEGAPRFSTYAVLGAHVWRCASLARGLAPEQPTKLYCATDGRQRLTPTHPDGYFGNVIFTATPLAEAGKVTGSLADGATTIQDALEKMDDEYCHSALDYLELQPDLSALVRGAHTFRCPNLGLTSWVRLPIHDADFGWGRPVFMGPGGIAYEGLAFVLPSANRDGSLSVAISLQAEHMEKFRKMIFDF

SEQ ID NO: 272 - protein, 440 aa, Avena sativa
  misc_feature (1)..(440): Public GI no. 32400293
  misc_feature (1)..(440): Functional Homolog of  Ceres CLONE ID no. 114130 at SEQ ID NO. 240
  misc_feature (1)..(440): Pfam Name: Transferase Pfam Description: Transferase family
  misc_feature (1)..(440): Bit score of 1079.4 for HMM based on sequences of FIGURE 12.
MKITVRSTTVVVPAAETPRLRLWNANPDLVVPRFHTPSVYFYRRGDGDGAACYFDAARMRRALAEALVTFYPMAGRLAHDEDGRVEIDCNAEGVLFLEADAPDGTVDDFGDFAPTMGLKRLIPTVDFTGGISSYPLLVAQVTHFKCGGVALGIGMQHHVADGFSGLHFINSWSDICRGVPIAVMPFIDRTLLRARDPPVPTHPHIEYQPAPAMLGSEEPQALAGKPESPPTAVDIFKLSRSDLGRLRAQLPTGEGAPRFSTYAVLGAHVWRCASMARGLAPEQPTKLYCATDGRQRLTPTLPDGYFGNAIFTATPLAEAGKVTGSLADGATTIQEALEKMDDEYCHSALDYLELQPDLSALVRGAHTFRCPNLGLTSWVRLPIHDADFGWGRPVFMGPGGIAYEGLAFVLPSANRDGSLSVAISLQAEHMEKFRKMIFDF

SEQ ID NO: 273 - protein, 431 aa, Ipomoea batatas
  misc_feature (1)..(431): Public GI no. 6469032
  misc_feature (1)..(431): Functional Homolog of  Ceres CLONE ID no. 114130 at SEQ ID NO. 240
  misc_feature (6)..(431): Pfam Name: Transferase Pfam Description: Transferase family
  misc_feature (6)..(431): Pfam Name: Transferase Pfam Description: Transferase family
  misc_feature (1)..(431): Bit score of 1074.7 for HMM based on sequences of FIGURE 12.
MASEKFKISIKESTMVKPAKPTPAKRLWNSNLDLIVGRIHLLTVYFYRPNGSPNFFDSKVMKEALSNVLVSFYPMAGRLARDGEGRIEIDCNEEGVLFVEAESDACVDDFGDFTPSLELRKFIPTVDTSGDISSFPLIIFQVTRFKCGGVCLGTGVFHTLSDGVSSLHFINTWSDMARGLSVAIPPFIDRTLLRARDPPTPAFEHSEYDQPPKLKSVPESKRGSSASTTMLKITPEQLALLKTKSKHEGSTYEILAAHIWRCACKARGLTDDQATKLYVATDGRSRLCPPLPPGYLGNVVFTATPMAESGELQSEPLTNSAKRIHSALSRMDDEYLRSALDFLECQPDLSKLIRGSNYFASPNLNINSWTRLPVHESDFGWGRPIHMGPACILYEGTVYILPSPNKDRTLSLAVCLDAEHMPLFKEFLYDF

SEQ ID NO: 274 - protein, 430 aa, Lycopersicon esculentum
  misc_feature (1)..(430): Public GI no. 40644084
  misc_feature (1)..(430): Functional Homolog of  Ceres CLONE ID no. 114130 at SEQ ID NO. 240
  misc_feature (7)..(430): Pfam Name: Transferase Pfam Description: Transferase family
  misc_feature (1)..(430): Bit score of 1045.6 for HMM based on sequences of FIGURE 12.
MGSEKMMKINIKESTLVKPSKPTPTKRIWSSNLDLIVGRIHLLTVYFYKPNGSSNFFDNKVIKEALSNVLVSFYPMAGRLGRDEQGRIEVNCNGEGVLFVEAESDSCVDDFGDFTPSLELRKLIPSVETSGDISTFPLVIFQITRFKCGGVALGGGVFHTLSDGLSSIHFINTWSDIARGLSVAVPPFIDRTLLRARDPPTYSFEHVEYHPPPTLNSSKNRESSTTTMLKFSSEQLGLLKSKSKNEGSTYEILAAHIWRCTCKARGLPEDQLTKLHVATDGRSRLCPPLPPGYLGNVVFTATPIAKSCELQSEPLTNSVKRIHNELIKMDDNYLRSALDYLELQPDLSTLIRGPAYFASPNLNINSWTRLPVHECDFGWGRPIHMGPACILYEGTIYIIPSPNSKDRNLRLAVCLDAGHMSLFEKYLYEL

SEQ ID NO: 275 - protein, 433 aa, Solanum tuberosum
  misc_feature (1)..(433): Public GI no. 76573303
  misc_feature (1)..(433): Functional Homolog of  Ceres CLONE ID no. 114130 at SEQ ID NO. 240
  misc_feature (7)..(431): Pfam Name: Transferase Pfam Description: Transferase family
  misc_feature (1)..(433): Bit score of 1031.6 for HMM based on sequences of FIGURE 12.
MGSEKMMKINIKESTLVKPSKPTPTKRIWSSNLDLIVGRIHLLTVYFYKPNGSSSFFDNKVMKEALSNVLVSFYPMAGRLARDEQGRIEVNCNGEGVLFVEAESDSCIDDFGDFTPCLELKKLIPSVETSGDISTFPLAIFQVTRFKCGGIALGGGVFHTLSDGLSSLHFINTWSDIARGLSVAVPPFIDRTLLHAREPPTSSFEHVEYHPPPTLISSKKGESTGPKSSTTAMLKFSSEQVGLLKSKSENEGSTYEILAAHIWRCTSKARGLADDQLTKLHVATDGRSRLCPPLPPGYLGNVVFTATPIAKSCELQSEPLRNSVKRIPNELIKMDDNYLRSALDYLELQPDLSTLIRGPTYFTSPNLNINSWTRLPVHECDFGWGRPIHMGPACILYEGTIYIIPSPNTKDRNLRLAVCLDPDHMPLFEKYLC

SEQ ID NO: 276 - protein, 446 aa, Dianthus caryophyllus
  misc_feature (1)..(446): Public GI no. 3288180
  misc_feature (1)..(446): Functional Homolog of  Ceres CLONE ID no. 114130 at SEQ ID NO. 240
  misc_feature (1)..(446): Pfam Name: Transferase Pfam Description: Transferase family
  misc_feature (1)..(446): Pfam Name: Transferase Pfam Description: Transferase family
  misc_feature (1)..(446): Bit score of 941 for HMM based on sequences of FIGURE 12.
MSIQIKQSTMVRPAEETPNKSLWLSKIDMILRTPYSHTGAVLIYKQPDNNEDNIHPSSSMYFDANILIEALSKALVPYYPMAGRLKINGDRYEIDCNAEGALFVEAESSHVLEDFGDFRPNDELHRVMVPTCDYSKGISSFPLLMVQLTRFRCGGVSIGFAQHHHACDGMSHFEFNNSWARIAKGLLPALEPVHDRYLHLRLRNPPQIKYTHSQFEPFVPSLPNELLDGKTNKSQTLFKLSREQINTLKQKLDLSSNTTTRLSTYEVVAGHVWRSVSKARGLSDHEEIKLIMPVDGRSRINNPSLPKGYCGNVVFLAVCTATVGDLSCNPLTDTAGKVQEALKGLDDDYLRSAIDHTESKPDLPVPYMGSPEKTLYPNVLVNSWGRIPYQAMDFGWGSPTFFGISNIFYDGQCFLIPSQNGDGSMTLAINLFSSHLSLFKKYFYDF

SEQ ID NO: 277 - protein, 445 aa, Dianthus caryophyllus
  misc_feature (1)..(445): Public GI no. 2239091
  misc_feature (1)..(445): Functional Homolog of  Ceres CLONE ID no. 114130 at SEQ ID NO. 240
  misc_feature (1)..(445): Pfam Name: Transferase Pfam Description: Transferase family
  misc_feature (1)..(445): Pfam Name: Transferase Pfam Description: Transferase family
  misc_feature (1)..(445): Bit score of 917.1 for HMM based on sequences of FIGURE 12.
MSIHIKQSTMVRPAEETPNKSLWLSKIDMILRTPYSHTGAVLIYKQPDNNEDNIQPSSSMYFDANILIEALSKALVPYYPMAGRLKINGDRYEIDCNGEGALFVEAESSHVLEDFGDFRPNDELHRVMVPTCDYSKGISSFPLLMVQLTRFRCGGVSIGFAQHHHVCDRMSHFEFNNSWARIAKGLLPALEPVHDRYLHLCPRNPPQIKYTHSQFEPFVPSLPKELLDGKTSKSQTLFKLSREQINTLKQKLDWSNTTTRLSTYEVVAGHVWRSVSKARGLSDHEEIKLIMPVDGRSRINNPSLPKGYCGNVVFLAVCTATVGDLACNPLTDTAGKVQEALKGLDDDYLRSAIDHTESKPDLPVPYMGSPEKTLYPNVLVNSWGRIPYQAMDFGWGNPTFFGISNIFYDGQCFLIPSQNGDGSMTLAINLFSSHLSLFKKHFYDF

SEQ ID NO: 278 - protein, 445 aa, Dianthus caryophyllus
  misc_feature (1)..(445): Public GI no. 2239087
  misc_feature (1)..(445): Functional Homolog of  Ceres CLONE ID no. 114130 at SEQ ID NO. 240
  misc_feature (1)..(445): Pfam Name: Transferase Pfam Description: Transferase family
  misc_feature (1)..(445): Pfam Name: Transferase Pfam Description: Transferase family
  misc_feature (1)..(445): Bit score of 921.2 for HMM based on sequences of FIGURE 12.
MSIQIKQSTMVRPAEETPNKSLWLSNIDMILRTPYSHTGAVLIYKQPDNNEDNIHPSSSMYFDANILIEALSKALVPFYPMAGRLKINGDRYEIDCNAEGALFVEAESSHVLEDFGDFRPNDELHRVMVPTCDYSKGISSFPLLMVQLTRFRCGGVSIGFAQHHHVCDGMAHFEFNNSWARIAKGLLPALEPVHDRYLHLRPRNPPQIKYSHSQFEPFVPSLPNELLDGKTNKSQTLFILSREQINTLKQKLDLSNNTTRLSTYEVVAAHVWRSVSKARGLSDHEEIKLIMPVDGRSRINNPSLPKGYCGNVVFLAVCTATVGDLSCNPLTDTAGKVQEALKGLDDDYLRSAIDHTESKPGLPVPYMGSPEKTLYPNVLVNSWGRIPYQAMDFGWGSPTFFGISNIFYDGQCFLIPSRDGDGSMTLAINLFSSHLSRFKKYFYDF

SEQ ID NO: 279 - protein, 442 aa, Dianthus caryophyllus
  misc_feature (1)..(442): Public GI no. 2239085
  misc_feature (1)..(442): Functional Homolog of  Ceres CLONE ID no. 114130 at SEQ ID NO. 240
  misc_feature (1)..(442): Pfam Name: Transferase Pfam Description: Transferase family
  misc_feature (1)..(442): Pfam Name: Transferase Pfam Description: Transferase family
  misc_feature (1)..(442): Bit score of 941 for HMM based on sequences of FIGURE 12.
QIKQSTMVRPAEETPNKSLWLSKIDMILRTPYSHTGAVLIYKQPDNNEDNIHPSSSMYFDANILIEALSKALVPFYPMAGRLKINGDRYEIDCNAEGALFVEAESSHVLEDFGDFRPNDELHRVMVPTCDYSKGISSFPLLMVQLTRFRCGGVSIGFAQHHHVCDGMAHFEFNNSWARIAKGLLPALEPVHDRYLHLRPRNPPQIKYSHSQFEPFVPSLPNELLDGKTNKSQTLFILSREQINTLKQKLDLSNNTTRLSTYEVVAGHVWRSVSKARGLSDHEEIKLIMPVDGRSRINNPSLPKGSCGNVVFLAVCTATVGDLSCNPLTDTAGKVQEALKGLDDDYLRSAIDHTESKPGLPVPYMGSPEKTLYPNVLVNSWGRIPYQAMDFGWGSPTFFGISNIFYDGQCFLIPSRDGDGSMTLAINLFSSHLSRFKKYFYDF

SEQ ID NO: 280 - DNA, 1572 bp, Arabidopsis thaliana
  misc_feature (1)..(1572): Ceres CLONE ID no. 11988
  misc_feature (1)..(1572): Ceres GEMINI ID 24A4
  misc_feature (1)..(1572): Ceres SEED LINE ME00259
ctctctctctctctcacttcatctatggcttcttcttctctgcagtctctcttctctctgttttgccttgctctgttctctcttcctctcatcgtctcctccatcggcatcaactatggccaggtcgctaacaaccttcctccccctaaaaacgtcatccctctcctcaagtctgtgggagctacaaaagtcaagctctatgacgccgatccacaagccctacgtgccttcgccggctccggcttcgagctcaccgtggccctcggtaacgagtacctggctcagatgagcgaccctattaaagcccaaggctgggtgaaggagaacgtccaagcttacctcccaaacaccaagatcgtggccatcgtagtgggaaacgaagtcctcacctcaaaccagtcagccctcacggcagccctcttcccggctatgcaaagcatccacggtgctctggtggattgtggcctaaacaagcagatctttgtgacgacggctcactcactagccatcttggatgtatcctaccctccctcggccacttccttccgccgcgacctcctcggctccctcactcccatcttggacttccacgtcaagactggctcaccaatcctcatcaacgcctaccctttcttcgcctacgaagaaaaccccaaacacgtttctctcgacttcgtactcttccaaccaaatcaaggcttcaccgatcctggctctaatttccactacgacaacatgctcttcgctcaggtcgacgcagtctatcacgctcttgacgctgtcggcatcagctacaagaaagttcccattgtcgtctccgagaccggatggccttccaacggtgacccgcaagaagtcggagccacctgcgacaatgctcgcaagtacaatgggaatctgatcaagatgatgatgagcaagaagatgaggacgcctattcgacctgagtgcgatctcaccatcttcgtctttgctctctttaacgagaacatgaagcctggaccaacctccgagaggaactacggtctcttcaaccctgacggaactccggtttactcacttgggatcaagacctcttccactcatagtagtggtagtggtagcagcaactccactggtggtagtagcagtggcggtggcggtaacactggtggctcttccagcggtggtggcatctatcagccagtcacgggtaacccatcaccggattacatgtccatttcctccgccgggggaaaaggcagattcgttgagtgtgtgttgttcttcttcttgctttgcatcatcaagcttcggttgtaaaagcttctccactagatctcgtcggctttgtacttttacgcggttgatgacgtgatatagcccccaaatttaatttaattagttttgtgttggtgttttggtcggaggatgatttaggagacataccatctttgttgtgccgacctcctctccaactcttttcttttttccattccatcctcctttttcttgtttaagcatagattatttaaataatgaatcttagttgattagatttttctaaagaagatgatgattttcgataaaagc

SEQ ID NO: 281 - protein, 425 aa, Arabidopsis thaliana
  misc_feature (1)..(425): Ceres CLONE ID no. 11988
  misc_feature (1)..(425): Ceres GEMINI ID 24A4
  misc_feature (1)..(425): Ceres SEED LINE ME00259
  misc_feature (27)..(348): Pfam Name: Glyco_hydro_17 Pfam Description: Glycosyl hydrolases family 17
  misc_feature (1)..(425): Bit score of 1028.4 for HMM based on sequences of FIGURE 20.
MASSSLQSLFSLFCLALFSLPLIVSSIGINYGQVANNLPPPKNVIPLLKSVGATKVKLYDADPQALRAFAGSGFELTVALGNEYLAQMSDPIKAQGWVKENVQAYLPNTKIVAIVVGNEVLTSNQSALTAALFPAMQSIHGALVDCGLNKQIFVTTAHSLAILDVSYPPSATSFRRDLLGSLTPILDFHVKTGSPILINAYPFFAYEENPKHVSLDFVLFQPNQGFTDPGSNFHYDNMLFAQVDAVYHALDAVGISYKKVPIVVSETGWPSNGDPQEVGATCDNARKYNGNLIKMMMSKKMRTPIRPECDLTIFVFALFNENMKPGPTSERNYGLFNPDGTPVYSLGIKTSSTHSSGSGSSNSTGGSSSGGGGNTGGSSSGGGIYQPVTGNPSPDYMSISSAGGKGRFVECVLFFFLLCIIKLRL

SEQ ID NO: 282 - protein, 425 aa, Zea mays
  misc_feature (1)..(425): Ceres CLONE ID no. 1145901
  misc_feature (1)..(425): Functional Homolog of  Ceres CLONE ID no. 11988
  misc_feature (27)..(348): Pfam Name: Glyco_hydro_17 Pfam Description: Glycosyl hydrolases family 17
  misc_feature (1)..(425): Bit score of 1028 for HMM based on sequences of FIGURE 20.
MASSSLQSLFSLFCLALFSLPLIVSSIGINYGQVANNLPPPKNVIPLLKSVGATKVKLYDADPQALRAFAGSGFELTVALGNEYLAQMSDPIKAQGWVKENVQAYLPNTKIVAIVVGNEVLTSNQSALTAALFPAMQRIHGALVDCGLNKQIFVTTAHSLAILDVSYPPSATSFRRDLLGSLTPILDFHVKTGSPILINAYPFFAYEENPKHVSLDFVLFQPNQGFTDPGSNFHYDNMLFAQVDAVYHALDAVGISYKKVPIVVSETGWPSNGDPQEVGATCDNARKYNGNLIKMMMSKKMRTPIRPECDLTIFVFALFNENMKPGPTSERNYGLFNPDGTPVYSLGIKTSSTHSSGSGSSNSTGGSSSGGGGNTGGSSSGGGIYQPVTGNPSPDYMSISSAGGKGRFVECVLFFFLLCIIKLRL

SEQ ID NO: 283 - DNA, 1319 bp, Arabidopsis thaliana
  misc_feature (1)..(1319): Ceres CLONE ID no. 21243
  misc_feature (1)..(1319): Ceres GEMINI ID 547G11
  misc_feature (1)..(1319): Ceres SEED LINE ME12890
aaaaaactctctcaaaccataaaaaatattctccgatcatcattttaatggagagtacagattcttccggtggtcctccgccgccgcaaccaaacctccctccaggattccggtttcatccaacagacgaagaacttgtaattcattacctcaaacgcaaagcagattctgttcctttaccagtcgcgatcatcgccgacgttgatctttacaaatttgatccatgggaacttcccgcgaaagcttcgtttggagaacaagaatggtattttttcagtccaagagatcggaaatatcccaacggagctagacctaaccgagctgcgacttccggttattggaaagcgactggtacagataaaccggtgatttcaaccggcggtggtggtagtaaaaaagtgggagttaaaaaggctctagtgttttacagtggtaaaccaccaaaaggagttaaatcagattggattatgcatgaatatcggttaactgataataaacctactcatatttgtgacttcggcaacaagaaaaactctctcaggcttgatgattgggtgttgtgtcgtatctacaagaaaaacaatagtacagcatctagacatcatcatcatcttcatcatattcatctagataatgatcatcatcgtcatgatatgatgattgatgatgatcgattccgtcatgttcctcctggtcttcacttcccggcgattttttctgacaataatgatccgacggctatatatgatggtggcggcggcggatacggaggtggaagttactcgatgaatcattgtttcgcatctggatcaaagcaggagcagttgtttccaccggtgatgatgatgactagtctaaatcaagattccggtattggatcgtcgtcgtcacctagcaagagatttaacggcggcggcgttggagattgttcgacttctatggcggcgacgccgttaatgcagaaccaaggtgggatttaccaattgcctggtttgaattggtattcttgaaaacaatttacgatgaagaatttttaaaatttgtgtatatatatacggtttgagtgattaggggcattgggggatttatttacggttgattattattgtagtgttatagaactaaggagattaaattaaatagattggaggagaggtataaggtaacatatagaaattatacaacaatagtttaaatattcttttcttttctttttcatgttattatttttactaatgtataggtgatgattatacttagatgtttgtagcttgtataaattaatgcatgcatatatataaaaatatattaacagttat

SEQ ID NO: 284 - protein, 320 aa, Arabidopsis thaliana
  misc_feature (1)..(320): Ceres CLONE ID no. 21243
  misc_feature (1)..(320): Ceres GEMINI ID 547G11
  misc_feature (1)..(320): Ceres SEED LINE ME12890
  misc_feature (17)..(147): Pfam Name: NAM Pfam Description: No apical meristem (NAM) protein
  misc_feature (1)..(320): Bit score of 617.3 for HMM based on sequences of FIGURE 21.
MESTDSSGGPPPPQPNLPPGFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCRIYKKNNSTASRHHHHLHHIHLDNDHHRHDMMIDDDRFRHVPPGLHFPAIFSDNNDPTAIYDGGGGGYGGGSYSMNHCFASGSKQEQLFPPVMMMTSLNQDSGIGSSSSPSKRFNGGGVGDCSTSMAATPLMQNQGGIYQLPGLNWYS

SEQ ID NO: 285 - DNA, 604 bp, Arabidopsis thaliana
  misc_feature (1)..(604): Ceres CLONE ID no. 38915
  misc_feature (1)..(604): Ceres GEMINI ID 50C9
  misc_feature (1)..(604): Ceres SEED LINE ME01050
attcatcgcatcccccacacacctcattaacattataattgtttttttagttattcttcaatttcaagaaaatgctgcaaggctttctcttcctcctctcagtcgtactcctcttctcctcatctgcagccgcctgcgaccgatgtcttcacagttctaaggcagcttatttctcctctgcatctgctctctcctctggagcttgtgcatatggctctatggctaccggtttcttcgccggacacattgctgcggctctgccttccatctacaaagacggctccggctgcggagcttgcttccaggtcagatgcaagaacccgacgctttgcagcagcaaaggaaccacggtgattgtcacagacttgaacaagaccaaccaaaccgatcttgtccttagcagcagagcctttagggccatggctaagcctgttgttggcgccgacagagatcttctcaaacaaggcattgtcgatattgaatacaggagagttccttgcgattacggtaacaagaagatgaacgtgagagttgaagaatcaagcaaaaatccaaactacttggcgataaagctcttgtaccaaggaggccaaactgaagtggt

SEQ ID NO: 286 - protein, 177 aa, Arabidopsis thaliana
  misc_feature (1)..(177): Ceres CLONE ID no. 38915
  misc_feature (1)..(177): Ceres GEMINI ID 50C9
  misc_feature (1)..(177): Ceres SEED LINE ME01050
  misc_feature (150)..(177): Pfam Name: Pollen_allerg_1 Pfam Description: Pollen allergen
  misc_feature (59)..(138): Pfam Name: DPBB_1 Pfam Description: Rare lipoprotein A (RlpA)-like double-psi beta-barrel
  misc_feature (1)..(177): Bit score of 521.1 for HMM based on sequences of FIGURE 13.
MLQGFLFLLSVVLLFSSSAAACDRCLHSSKAAYFSSASALSSGACAYGSMATGFFAGHIAAALPSIYKDGSGCGACFQVRCKNPTLCSSKGTTVIVTDLNKTNQTDLVLSSRAFRAMAKPVVGADRDLLKQGIVDIEYRRVPCDYGNKKMNVRVEESSKNPNYLAIKLLYQGGQTEV

SEQ ID NO: 287 - protein, 168 aa, Zea mays
  misc_feature (1)..(168): Ceres CLONE ID no. 1375697
  misc_feature (1)..(168): Functional Homolog of  Ceres CLONE ID no. 38915 at SEQ ID NO. 286
  misc_feature (57)..(136): Pfam Name: DPBB_1 Pfam Description: Rare lipoprotein A (RlpA)-like double-psi beta-barrel
  misc_feature (1)..(168): Bit score of 479.7 for HMM based on sequences of FIGURE 13.
MGSCFLVLVVLLFSSSVNACDRCLHRSKAAYFSSASALSSGACSYGSMATGFFAGHIAAAVPSIYKDGAGCGACFQVRCTNPSLCSTKGTTVMVTDLNRSNQTDLLLSSRAFRAMAKPVLGADRDLLRQGIVDVQYQRVPCDYGNKKMMNVRVEESSKKPNYLAIKLL

SEQ ID NO: 288 - DNA, 751 bp, Arabidopsis thaliana
  misc_feature (1)..(751): Ceres CLONE ID no. 41046
  misc_feature (1)..(751): Ceres GEMINI ID 88H4
  misc_feature (1)..(751): Ceres SEED LINE ME01739
agcagcttcttctgctttcaattactctcgccgacgattttctcaccggaaaaaaacaatatcattgcggatacacaaactataatggacctcctcttgctggagaagtctttaatcgccgtcttcgtggcggtgattcttgccacggtgatttcaaagctccgcggcaagaaattgaagctacctccaggtcctataccaattccgatcttcggaaactggcttcaagtcggagatgatctcaaccaccgtaatctcgtcgattacgctaagaaattcggcgatctcttcctcctccgtatgggtcagcgaaacctagtcgtcgtctcctcaccggatctaacaaaggaagtgctcctcactcaaggcgttgagtttggatccagaacgagaaacgtcgtgttcgacattttcaccgggaaaggtcaagatatggtgttcactgtttacggcgagcattggaggaagatgagaagaatcatgacggttcctttcttcaccaacaaagttgttcaacagaatcgtgaaggttgggagtttgaagcagctagtgttgttgaagatgttaagaagaatccagattctgctacgaaaggaatcgtgttgaggaaacgtttgcaattgatgatgtataacaatatgttccgtatcatgttcgatagaagatttgagagtgaggatgatcctcttttccttaggcttaaggctttgaatggtgagagaatcttaaggcatcatcagctttagcttc

SEQ ID NO: 289 - protein, 220 aa, Arabidopsis thaliana
  misc_feature (1)..(220): Ceres CLONE ID no. 41046
  misc_feature (1)..(220): Ceres GEMINI ID 88H4
  misc_feature (1)..(220): Ceres SEED LINE ME01739
  misc_feature (34)..(212): Pfam Name: p450 Pfam Description: Cytochrome P450
  misc_feature (1)..(220): Bit score of 320.1 for HMM based on sequences of FIGURE 22.
MDLLLLEKSLIAVFVAVILATVISKLRGKKLKLPPGPIPIPIFGNWLQVGDDLNHRNLVDYAKKFGDLFLLRMGQRNLVVVSSPDLTKEVLLTQGVEFGSRTRNVVFDIFTGKGQDMVFTVYGEHWRKMRRIMTVPFFTNKVVQQNREGWEFEAASVVEDVKKNPDSATKGIVLRKRLQLMMYNNMFRIMFDRRFESEDDPLFLRLKALNGERILRHHQL

SEQ ID NO: 290 - DNA, 1032 bp, Arabidopsis thaliana
  misc_feature (1)..(1032): Ceres CLONE ID no. 8049
  misc_feature (1)..(1032): Ceres GEMINI ID 88H6
  misc_feature (1)..(1032): Ceres SEED LINE ME01752
accaagaaaaacacaatcgtttaatctcacccaagaagacaaaaacacagagagagaaagagagagaaatggcgacgacaacaacagaagcaacgaagacatcatcgaccaatggagaagatcagaagcagtctcagaatcttcgacatcaagaagttggtcacaagagtctcttacagagcgatgatctctaccagtatatactggagacaagtgtgtatcctagagaaccagaatcaatgaaggaactcagggaagtgacagcaaaacatccatggaacataatgaccacatcagctgatgaaggacagttcttaaacatgcttatcaagctcgttaacgccaagaacacaatggagatcggagtttacactggctactctcttctcgccaccgctcttgctctccctgaagacggcaaaattctggctatggatgtcaacagagagaattacgaattgggtttaccgatcattgagaaagccggcgttgctcacaagatcgacttcagggaaggccctgctcttcccgttcttgatgaaatcgttgctgacgagaagaaccatggaacatatgactttatattcgttgatgctgacaaagacaactacatcaactaccacaagcgtttgatcgatcttgtgaaaattggaggagtgattggctacgacaacactctgtggaatggttctgtcgtggctcctcctgatgcaccaatgaggaagtacgttcgttactacagagactttgttcttgagcttaacaaggctcttgctgctgaccctcggatcgagatctgtatgctccctgttggtgatggaatcactatctgccgtcggatcagttgatttgactcctccctactctgagtttgtccacagtggattactttccatcttcttatacctttcaatcgcattttcaccaaccactaaaatggacctttttatgtatttgtgttaagtaatatctccattgtccttgttttgctttcttctgaacaaagaaataatatgtaccttacttttcttc

SEQ ID NO: 291 - protein, 259 aa, Arabidopsis thaliana
  misc_feature (1)..(259): Ceres CLONE ID no. 8049
  misc_feature (1)..(259): Ceres GEMINI ID 88H6
  misc_feature (1)..(259): Ceres SEED LINE ME01752
  misc_feature (46)..(258): Pfam Name: Methyltransf_3 Pfam Description: O-methyltransferase
  misc_feature (46)..(258): Pfam Name: Methyltransf_3 Pfam Description: O-methyltransferase
MATTTTEATKTSSTNGEDQKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDEIVADEKNHGTYDFIFVDADKDNYINYHKRLIDLVKIGGVIGYDNTLWNGSVVAPPDAPMRKYVRYYRDFVLELNKALAADPRIEICMLPVGDGITICRRIS

SEQ ID NO: 292 - protein, 258 aa, Zea mays
  misc_feature (1)..(258): Ceres CLONE ID no. 1365873
  misc_feature (1)..(258): Functional Homolog of  Ceres CLONE ID no. 8049 at SEQ ID NO. 291
  misc_feature (45)..(257): Pfam Name: Methyltransf_3 Pfam Description: O-methyltransferase
  misc_feature (45)..(257): Pfam Name: Methyltransf_3 Pfam Description: O-methyltransferase
  misc_feature (1)..(258): Bit score of 685.2 for HMM based on sequences of FIGURE 14.
MATTTAEATKTSSTNVEDKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDQLVADEKNHGTYDFIFVDADKDNYINYHKRLIDLVKVGGVIGYDNTLWNGSVVAPPDAPMRKYVRYYRDFVLELNKALAADPRIEICMLPVGDGITICRRIS

SEQ ID NO: 293 - protein, 240 aa, Nicotiana tabacum
  misc_feature (1)..(240): Public GI no. 1679853
  misc_feature (1)..(240): Functional Homolog of  Ceres CLONE ID no. 8049 at SEQ ID NO. 291
  misc_feature (27)..(239): Pfam Name: Methyltransf_3 Pfam Description: O-methyltransferase
  misc_feature (27)..(239): Pfam Name: Methyltransf_3 Pfam Description: O-methyltransferase
  misc_feature (1)..(240): Bit score of 673.3 for HMM based on sequences of FIGURE 14.
MAENGIKHQEVGHKSLLQSDALYQYILETSVYPREPESMKELREVTAKHPWNLMTTSADEGQFLNMLLKLINAKNTMEIGVYTGYSLLATALAIPDDGKILAMDINRENYEIGLPIIEKAGVAHKIEFREGPALPVLDQLVEDKKNHGTYDFIFVDADKDNYINYHKRIIDLVKVGGLIGYDNTLWNGSVVAPPDAPMRKYVRYYRDFVLELNKALAADPRIEICMLPVGDGITLCRRIT

SEQ ID NO: 294 - protein, 247 aa, Betula platyphylla
  misc_feature (1)..(247): Public GI no. 57639629
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 693.5 for HMM based on sequences of FIGURE 14.
MATNGEDNQNQVSRHQEVGHKSLLQSDALYQYILETSVYPKEPEPMKELREVTAKHPWNIMTTSADEGQFLNMLLKLINAKNTMEIGVYTGYSLLATALALPDDGKILAMDINRENYELGLPVIEKAGVAHKIDFREGPALPLLDQLIADEKNHGSYDFIFVDADKDNYINYHKRLIDLVKVGGVIGYDNTLWNGSVVAPPDAPLRKYVRYYRDFVLELNKALAADPRIEICMLPVGDGITLCRRIK

SEQ ID NO: 295 - protein, 240 aa, Nicotiana tabacum
  misc_feature (1)..(240): Public GI no. 2511737
  misc_feature (1)..(240): Functional Homolog of  Ceres CLONE ID no. 8049 at SEQ ID NO. 291
  misc_feature (27)..(239): Pfam Name: Methyltransf_3 Pfam Description: O-methyltransferase
  misc_feature (27)..(239): Pfam Name: Methyltransf_3 Pfam Description: O-methyltransferase
  misc_feature (1)..(240): Bit score of 672.4 for HMM based on sequences of FIGURE 14.
MAENGIKHQEVGHKSLLQSDALYQYILETSVYPREPESMKELREVTAKHPWNLMTTSADEGQFLNMLLKLINAKNTMEIGVYTGYSLLATALAIPDDGKILAMDINRENYEIGLPIIEKAGVAHKIEFREGPALPVLDQLVEDKKNHGTYDFIFVDADKDNYINYHKRIIDLVKVGGLIGYDNTLWNGSVVAPPDAPMRKYVRYYRDFVLELNKALAVDPRIEICMLPVGDGITLCRRIT

SEQ ID NO: 296 - protein, 247 aa, Glycine max
  misc_feature (1)..(247): Ceres CLONE ID no. 538586
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 685 for HMM based on sequences of FIGURE 14.
MAEQNQNQTTEAGRHQEVGHKSLLQSDALYQYILETSVYPREPESMKELRELTAKHPWNIMTTSADEGQFLNMLLKLINAKNTMEIGVYTGYSLLATALALPEDGKILAMDINRENYELGLPVIKKAGVDHKIEFREGPALPVLDEMVKDEKNHGSYDFIFVDADKDNYLNYHKRLIELVKVGGVIGYDNTLWNGSVVAPPDAPLRKYVRYYRDFVLELNKALAVDPRIEICMLPVGDGITICRRIK

SEQ ID NO: 297 - protein, 246 aa, Linum usitatissimum
  misc_feature (1)..(246): Public GI no. 68271859
  misc_feature (1)..(246): Functional Homolog of  Ceres CLONE ID no. 8049 at SEQ ID NO. 291
  misc_feature (33)..(245): Pfam Name: Methyltransf_3 Pfam Description: O-methyltransferase
  misc_feature (33)..(245): Pfam Name: Methyltransf_3 Pfam Description: O-methyltransferase
  misc_feature (1)..(246): Bit score of 675.5 for HMM based on sequences of FIGURE 14.
MAEQQQSGENVSRHQEVGHKSLLQSDDLYQYILETSVYPREPESMKELREVTAKHPWNIMTTSADEGQFLNMLLKLINAKNTMEIGVYTGYSLLATALALPDDGKILAMDINRENYEIGLPIIEKAGLAHKIEFKEGPALPALDKMVEDKANHGAYDFIFVDADKDNYINYHKRLIDLVKIGGVIGYDNTLWNGSVVAPPDAPLRKYVRYYRDFVLELNKALAADPRIEICMLPVGDGITLCRRIS

SEQ ID NO: 298 - protein, 247 aa, Glycine max
  misc_feature (1)..(247): Ceres CLONE ID no. 541352
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 685.2 for HMM based on sequences of FIGURE 14.
MAEQNQNQTTEAGRHQEVGHKSLLQSDALYQYILETSVYPREPESMKELRELTAKHPWNIMTTSADEGQFLNMLLKLINAKNTMEIGVYTGYSLLATALALPEDGKILAMDINRENYELGLPVIKKAGVDHKIEFREGPALPVLDEMIKDEKNHGSYDFIFVDADKDNYLNYHKRLIELVKVGGVIGYDNTLWNGSVVAPPDAPLRKYVRYYRDFVLELNKALAVDPRIEICMLPVGDGITICRRIK

SEQ ID NO: 299 - DNA, 1296 bp, Populus tomentosa; identical to SEQ ID NO: 255
  misc_feature (1)..(1296): Ceres ANNOT ID no.7271916

SEQ ID NO: 300 - protein, 239 aa, Populus tomentosa
  misc_feature (1)..(239): Public GI no. 7271916
  misc_feature (1)..(239): Functional Homolog of  Ceres CLONE ID no. 8049 at SEQ ID NO. 291
  misc_feature (26)..(238): Pfam Name: Methyltransf_3 Pfam Description: O-methyltransferase
  misc_feature (26)..(238): Pfam Name: Methyltransf_3 Pfam Description: O-methyltransferase
  misc_feature (1)..(239): Bit score of 668 for HMM based on sequences of FIGURE 14.
QSQAGRHQEVGHKSLLQSDALYQYILETSVYPREPECMKELREVTAKHPWNIMTTSADEGQFLNMLLKLVNAKNTMEIGVYTGYSLLATALAIPEDGKILAMDINRENYELGLPVIQKAGVAHKIDFKEGPALPVLDQMIEDGKYHGSFDFIFVDADKDNYINYHKRLIELVKVGGLIGYDSTLWNGSVVAPPDAPMRKYVRYYRDFVLELNKALAADPRIEICMLPVGDGITLCRRIQ

SEQ ID NO: 301 - DNA, 1296 bp, Populus tremuloides; identical to SEQ ID NO: 255
  misc_feature (1)..(1296): Ceres ANNOT ID no.3023436

SEQ ID NO: 302 - protein, 247 aa, Populus tremuloides
  misc_feature (1)..(247): Public GI no. 3023436
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 695.5 for HMM based on sequences of FIGURE 14.
MATNGEEQQSQAGRHQEVGHKSLLQSDALYQYILETSVYPREPECMKELREVTAKHPWNIMTTSADEGQFLNMLLKLVNAKNTMEIGVYTGYSLLATALAIPEDGKILAMDINRENYELGLPVIQKAGVAHKIDFKEGPALPVLDQMIEDGKYHGSFDFIFVDADKDNYINYHKRLIELVKVGGLIGYDNTLWNGSVVAPPDAPMRKYVRYYRDFVLELNKALAADPRIEICMLPVGDGITLCRRIQ

SEQ ID NO: 303 - DNA, 744 bp, Populus balsamifera subsp. trichocarpa
  misc_feature (1)..(744): Ceres ANNOT ID no.1514289
atggccaccaacggagaggaacagcaaagccaggcaggaaggcaccaggaagttggccacaagagccttttgcaaagtgatgctctttaccagtatattctcgagactagtgtgtatccaagagagcctgaatgcatgaaggagctcagggaggtgactgccaagcatccttggaacatcatgaccacatctgctgatgaagggcaattcttgaatatgcttttgaagcttgtcaatgccaaaaacaccatggagatcggtgtttacactggctattctctcttggccactgccctggctatccctgaggatggcaagatcttggctatggacatcaacagagaaaactatgaattgggtctcccagtaattcagaaagctggtgttgcgcacaagattgatttcaaggaaggccctgctctaccagttcttgatcaaatgattgaagatgggaagtgccatggaagttttgatttcatctttgtggatgctgacaaggacaattatataaattatcacaagaggttgattgagcttgtaaaagttggtgggctgattgggtacgacaacactctgtggaatggatctgtggtggctccacctgatgcaccaatgaggaagtatgtgaggtactacagggactttgttttggagctcaacaaggcacttgctgctgaccccaggattgaaatttgcatgcttcctgttggtgatggcatcactctctgccgtcggatccaatga

SEQ ID NO: 304 - protein, 247 aa, Populus balsamifera subsp. trichocarpa
  misc_feature (1)..(247): Ceres ANNOT ID no. 1514289
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 695.1 for HMM based on sequences of FIGURE 14.
MATNGEEQQSQAGRHQEVGHKSLLQSDALYQYILETSVYPREPECMKELREVTAKHPWNIMTTSADEGQFLNMLLKLVNAKNTMEIGVYTGYSLLATALAIPEDGKILAMDINRENYELGLPVIQKAGVAHKIDFKEGPALPVLDQMIEDGKCHGSFDFIFVDADKDNYINYHKRLIELVKVGGLIGYDNTLWNGSVVAPPDAPMRKYVRYYRDFVLELNKALAADPRIEICMLPVGDGITLCRRIQ

SEQ ID NO: 305 - protein, 247 aa, Medicago sativa
  misc_feature (1)..(247): Public GI no. 684942
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 682.2 for HMM based on sequences of FIGURE 14.
MATNEDQKQTESGRHQEVGHKSLLQSDALYQYILETSVFPREHEAMKELREVTAKHPWNIMTTSADEGQFLSMLLKLINAKNTMEIGVYTGYSLLATALAIPEDGKILAMDINKENYELGLPVIKKAGVDHKIDFREGPALPVLDEMIKDEKNHGSYDFIFVDADKDNYLNYHKRLIDLVKVGGVIGYDNTLWNGSVVAPPDAPLRKYVRYYRDFVLELNKALAVDPRIEICMLPVGDGITICRRIK

SEQ ID NO: 306 - protein, 242 aa, Vitis vinifera
  misc_feature (1)..(242): Public GI no. 1000519
  misc_feature (1)..(242): Functional Homolog of  Ceres CLONE ID no. 8049 at SEQ ID NO. 291
  misc_feature (29)..(241): Pfam Name: Methyltransf_3 Pfam Description: O-methyltransferase
  misc_feature (29)..(241): Pfam Name: Methyltransf_3 Pfam Description: O-methyltransferase
  misc_feature (1)..(242): Bit score of 674.1 for HMM based on sequences of FIGURE 14.
MATNQEAGRHQEVGHKSLLQSDALYQYILETSVYPREPESMKELRELTAQHPWNIMTTSADEGQFLNMLLKLINAKNTMEIGVYTGYSLLATALALPDDGKILAMDINKENYELGLPVIQKAGVAHKIDFKEGPALPVLDQMIEDGKYHGSFDFIFVDADKDNYLNYHKRLIDLVKVGGIIGYDNTLWNGSVVAPPDAPLRKYVRYYRDFVLELNKALAADPRIEICMLPVGDGITLCRRLS

SEQ ID NO: 307 - protein, 247 aa, Medicago truncatula
  misc_feature (1)..(247): Public GI no. 92873946
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 682.2 for HMM based on sequences of FIGURE 14.
MATNEDQNQTESGRHQEVGHKSLLQSDALYQYILETSVFPREHEAMKELREVTAKHPWNIMTTSADEGQFLSMLLKLINAKNTMEIGVYTGYSLLATALAIPEDGKILAMDINKENYELGLPVIKKAGVDHKIDFREGPALPVLDEMIKDEKNHGSYDFIFVDADKDNYLNYHKRLIDLVKVGGVIGYDNTLWNGSVVAPPDAPLRKYVRYYRDFVLELNKALAVDPRIEICMLPVGDGITICRRIK

SEQ ID NO: 308 - protein, 241 aa, Petroselinum crispum
  misc_feature (1)..(241): Public GI no. 992610
  misc_feature (1)..(241): Functional Homolog of  Ceres CLONE ID no. 8049 at SEQ ID NO. 291
  misc_feature (28)..(240): Pfam Name: Methyltransf_3 Pfam Description: O-methyltransferase
  misc_feature (28)..(240): Pfam Name: Methyltransf_3 Pfam Description: O-methyltransferase
  misc_feature (1)..(241): Bit score of 664.6 for HMM based on sequences of FIGURE 14.
MASNGESKHSEVGHKSLLQSDALYQYILETSVYPREPEAMKELREVTAKHPWNLMTTSADEGQFLNMLLKLINAKNTMEIGVYTGYSLLATALALPDDGKILAMDINRENYEIGLPIIEKAGVGHKIDFREGPALPVLDHMLEDGKYHGTFDFVFVDADKDNYINYHKRLIDLVKIGGLIGYDNTLWNGSVAQPADAPMRKYVRYYRDFVIELNKALAADPRIEICMLPVGDGVTLCRRIS

SEQ ID NO: 309 - protein, 247 aa, Broussonetia papyrifera
  misc_feature (1)..(247): Public GI no. 47680455
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 692.3 for HMM based on sequences of FIGURE 14.
MATNGEGKQNEAGRHQEVGHKSLLQSDALYQYILETSVYPREPEAMKELREITAKHPWNIMTTSADEGQFLNMLLKLINAKNTMEIGVYTGYSLLATALALPDDGKILAMDINRENYELGLPVIEKAGVAHKIDFREGPALPVLDQMIEDGKYHGSFDFIFVDADKDNYLNYHKRLIELVKVGGVIGYDNTLWNGSVVAPPDAPLRKYVRYYRDFVLELNKALAADPRIEICMLPVGDGITVCRRVS

SEQ ID NO: 310 - DNA, 744 bp, Populus alba x Populus glandulosa; identical to SEQ ID NO: 303
  misc_feature (1)..(744): Ceres ANNOT ID no.13249171

SEQ ID NO: 311 - protein, 247 aa, Populus alba x Populus glandulosa
  misc_feature (1)..(247): Public GI no. 13249171
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 681.5 for HMM based on sequences of FIGURE 14.
  misc_feature (130)..(130): Xaa is any aa, unknown, or other
MATNGEEQQSQAGRHQEVGHKSLLQSDALYQYILETSVYPREPECMKELREVTAKHPWNIMTTSADEGQFLNMLLKLVNAKNTMEIGVYTGYSLLATALAIPEDGEILAMDINRENYELGLPVIEKAGVXNKIEFKEGPALPVLDQMIEDGKYHGSYDFIFVDADKKNYINYHKRLIELVKVGGLIGYDNTLWNGSVVAPPDAPMRKYVRYYRDFVLELNKALAADSRIEICMLPVGDGITLCRRIQ

SEQ ID NO: 312 - protein, 241 aa, Ammi majus
  misc_feature (1)..(241): Public GI no. 48093469
  misc_feature (1)..(241): Functional Homolog of  Ceres CLONE ID no. 8049 at SEQ ID NO. 291
  misc_feature (28)..(240): Pfam Name: Methyltransf_3 Pfam Description: O-methyltransferase
  misc_feature (28)..(240): Pfam Name: Methyltransf_3 Pfam Description: O-methyltransferase
  misc_feature (1)..(241): Bit score of 663.8 for HMM based on sequences of FIGURE 14.
MASNGESKHSEVGHKSLLQSDALYQYILETSVYPREPEAMKELREVTAKHPWNLMTTSADEGQFLNMLLKLINAKNTMEIGVYTGYSLLATALALPDDGKILAMDINRENYEIGLPIIEKAGVGHKIDFREGPALPVLDQTLEDGKYHGTFDFVFVDADKDNYINYHKRLIDLVKVGGLIGYDNTLWNGSVAQPADAPMRKYVRYYRDFVIELNKALAADPRIEICMLPVGDGVTLCRRIS

SEQ ID NO: 313 - protein, 247 aa, Broussonetia papyrifera
  misc_feature (1)..(247): Public GI no. 46394464
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 689.2 for HMM based on sequences of FIGURE 14.
MATNGEGKQNEAGRHQEVGHKSLLQSDALYQYILETSVYPREPEAMKELREITAKHPWNIMTTSADEGQFLNMLLKLINAKNTMEIGVYTGYSLLATGLALPDDGKILAMDINRENYELGLPVIEKAGVAHKIDFREGPALPVLDQMIEDGKYHGSFDFIFVDADKDNYLNYHKRLIELVKVGGVIGYDNTLWNGSVVAPPDAPLRKYVRYYRDFVLELNKALAADPRIEICMLPVGDGITVCRRVS

SEQ ID NO: 314 - protein, 242 aa, Solanum tuberosum
  misc_feature (1)..(242): Public GI no. 24745969
  misc_feature (1)..(242): Functional Homolog of  Ceres CLONE ID no. 8049 at SEQ ID NO. 291
  misc_feature (29)..(241): Pfam Name: Methyltransf_3 Pfam Description: O-methyltransferase
  misc_feature (29)..(241): Pfam Name: Methyltransf_3 Pfam Description: O-methyltransferase
  misc_feature (1)..(242): Bit score of 675.6 for HMM based on sequences of FIGURE 14.
MASNGENGRHQEVGHKSLLQSDALYQYILETSVYPREPEAMKELREITAKHPWNLMTTSADEGQFLNMLLKLINAKNTMEIGVFTGYSLLATAMALPDDGKILAMDINRENYEIGLPVIEKAGLAHKIDFREGPALPVLDQMIEDGKYHGSYDFIFVDADKDNYLNYHKRLIDLVKVGGLIGYDNTLWNGSVVAPPDAPLRKYVRYYRDFVLELNKALAADPRIEICQLPVGDGITLCRRIS

SEQ ID NO: 315 - protein, 247 aa, Codonopsis lanceolata
  misc_feature (1)..(247): Public GI no. 82941443
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 686.2 for HMM based on sequences of FIGURE 14.
MATNGDSNAEQTTRHQEVGHKSLLQSDALYQYILETSVYPREPESMKELREATAKHPWNIMTTSADEGQFLNMLLKLINAKNTMEIGVFTGYSLLATALALPDDGKILAMDINRENYDIGRPIIEKAGVAHKIDFREGPALPVLDQMIEDGKYHGTFDFVFVDADKDNYINYHKRIIDLVKVGGLIGYDNTLWNGSVVAPPDAPMRKYVRYYRDFVLELNKALAADPRIEICMLPVGDGITLCRRVS

SEQ ID NO: 316 - protein, 250 aa, Corchorus capsularis
  misc_feature (1)..(250): Public GI no. 40795556
  misc_feature (1)..(250): Functional Homolog of  Ceres CLONE ID no. 8049 at SEQ ID NO. 291
  misc_feature (34)..(249): Pfam Name: Methyltransf_3 Pfam Description: O-methyltransferase
  misc_feature (34)..(249): Pfam Name: Methyltransf_3 Pfam Description: O-methyltransferase
  misc_feature (1)..(250): Bit score of 670 for HMM based on sequences of FIGURE 14.
MATNGEEQQSQAGRHQEVEHKSVLQSDALYQYILETSVYPREPEPMKELRELTAKHPWNLMTTSADEWQFLNMLLKLINAKNTMEIGVYTGYSLLATALALPDDAKILAMDINRENYELGLPVIQKAGVAHKIEFKEGPALPVLDKLVEDEKNHESYDFIFVDADKDNYINYINYHKRLIDLVKVGGLIGYDNTLWNGSVVAPPDAPMRKYVRYYRDFVLEINKALAADPRIEICMLPVEDGITVCRRIQ

SEQ ID NO: 317 - protein, 239 aa, Nicotiana tabacum
  misc_feature (1)..(239): Public GI no. 1574946
  misc_feature (1)..(239): Functional Homolog of  Ceres CLONE ID no. 8049 at SEQ ID NO. 291
  misc_feature (26)..(238): Pfam Name: Methyltransf_3 Pfam Description: O-methyltransferase
  misc_feature (26)..(238): Pfam Name: Methyltransf_3 Pfam Description: O-methyltransferase
  misc_feature (1)..(239): Bit score of 662.7 for HMM based on sequences of FIGURE 14.
MATNGRHQEVGHKSLLQSDALYQYILETSVYPREPEPMKELREITAKHPWNLMTTSADEGQFLSMLIKLINAKNTMEIGVFTGYSLLATAMALPDDGKILAMDINRENYEIGLPVIEKAGLAHKIEFKEGPALPVLDQMIEDGKYHGSYDFIFVDADKDNYLNYHKRLIDLVKIGGLIGYDNTLWNGSVVAPPDAPLRKYVRYYRDFVLELNKALAADSRIEICQLPVGDGITLCRRIS

SEQ ID NO: 318 - protein, 247 aa, Nicotiana tabacum
  misc_feature (1)..(247): Public GI no. 1103487
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 677.6 for HMM based on sequences of FIGURE 14.
MAENGAAQENQVTKHQEVGHKSLLQSDALYQYILETSVYPREPEPMKELRELTAKHPWNLMTTSADEGQFLSMLLKLIIAKNTMEIGVYTGYSLLATALALPDDGKILAMDINKENYELGLPVIQKAGVAHKIDFREGPALPVLDLMIEDKNNHGTYDFIFVDADKDNYINYHKRIIELVKVGGVIGYDNTLWNGSVVAPPDAPMRKYVRYYRDFVLELNKALAADPRIEICMLPVGDGITLCRRIS

SEQ ID NO: 319 - protein, 242 aa, Nicotiana tabacum
  misc_feature (1)..(242): Public GI no. 1575436
  misc_feature (1)..(242): Functional Homolog of  Ceres CLONE ID no. 8049 at SEQ ID NO. 291
  misc_feature (29)..(241): Pfam Name: Methyltransf_3 Pfam Description: O-methyltransferase
  misc_feature (29)..(241): Pfam Name: Methyltransf_3 Pfam Description: O-methyltransferase
  misc_feature (1)..(242): Bit score of 667.8 for HMM based on sequences of FIGURE 14.
MATNGENGRHQEVGHKSLLQSDALYQYILETSVYPREPEPMKELREITAKHPWNLMTTSADEGQFLSMLLKLINAKNTMEIGVFTGYSLLATAMALPDDGKILAMDINRENYEIGLPIIEKAGLAHKIVFREGPALPVLDQMIEDGKYHGSYDFIFVDADKDNYLNYHKRLIDLVKVGGLIGYDNTLWNGSVVAPPDAPLRKYVRYYRDFVLELNKALAADSRIEICQLPVGDGITLCRRIS

SEQ ID NO: 320 - DNA, 744 bp, Populus balsamifera subsp. trichocarpa
  misc_feature (1)..(744): Ceres ANNOT ID no.1441117
atggccgccaacggagaggaacagcagactcaggccggaaggcatcaagaagttggccacaagagccttttgcaaagtgatgctctttaccagtatattcttgagaccagtgtgtacccaagagagcctgaatgcatgaaggagcttagagagttgactgccaagcatccttggaacatcatgaccacatctgctgatgaagggcaattcttgaacatgcttttaaagcttatcaatgccaagaacaccatggagattggtgttttcactggctattctctcttggccactgctcttgctatccctgaggatggaaagatcttggctatggacatcaacagagaaaactatgaactgggtctcccggtgattcagaaagctggtctggaacacaagattgagttcaaggaaggccctgctctgccagttctcgatcaaatgattgaagatggaaagtaccatggaacttatgacttcatctttgtggatgctgacaaggacaattatattaactaccacaagaggttgattgagcttgtcaaagtcggagggttgattgggtatgacaacaccctgtggaatggatctgtggtggcaccagccgatgcgccgatgaggaagtatgtgaggtactatagggactttgttctggagctcaataaggcacttgcagctgaccccaggattgaaatttgcatgcttcctgttggtgatggtatcactctctgccgtcggatcaagtga

SEQ ID NO: 321 - protein, 247 aa, Populus balsamifera subsp. trichocarpa
  misc_feature (1)..(247): Ceres ANNOT ID no. 1441117
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 685.7 for HMM based on sequences of FIGURE 14.
MAANGEEQQTQAGRHQEVGHKSLLQSDALYQYILETSVYPREPECMKELRELTAKHPWNIMTTSADEGQFLNMLLKLINAKNTMEIGVFTGYSLLATALAIPEDGKILAMDINRENYELGLPVIQKAGLEHKIEFKEGPALPVLDQMIEDGKYHGTYDFIFVDADKDNYINYHKRLIELVKVGGLIGYDNTLWNGSVVAPADAPMRKYVRYYRDFVLELNKALAADPRIEICMLPVGDGITLCRRIK

SEQ ID NO: 322 - protein, 242 aa, Nicotiana tabacum
  misc_feature (1)..(242): Public GI no. 1575440
  misc_feature (1)..(242): Functional Homolog of  Ceres CLONE ID no. 8049 at SEQ ID NO. 291
  misc_feature (29)..(241): Pfam Name: Methyltransf_3 Pfam Description: O-methyltransferase
  misc_feature (29)..(241): Pfam Name: Methyltransf_3 Pfam Description: O-methyltransferase
  misc_feature (1)..(242): Bit score of 666.8 for HMM based on sequences of FIGURE 14.
MATDGENGRHQEVGHKSLLQSDALYQYILETSVYPREPEPMKELREITAKHPWNLMTTSADEGQFLSMLIKLINAKNTMEIGVFTGYSLLATAMALPDDGKILAMDINRENYEIGLPVIEKAGLAHKIEFKEGPALPVLDQMIEDGKYHGSYDFIFVDADKDNYLNYHKRLIDLVKIGGLIGYDNTLWNGSVVAPPDAPLRKYVRYYRDFVLELNKALAADSRIEICQLPVGDGITLCRRIS

SEQ ID NO: 323 - protein, 247 aa, Eucalyptus globulus
  misc_feature (1)..(247): Public GI no. 5739373
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 684.1 for HMM based on sequences of FIGURE 14.
MAANAEPQQTQPAKHSEVGHKSLLQSDALYQYILETSVYPREPESMKELREITAKHPWNLMTTSADEGQFLNMLLKLINAKNTMEIGVYTGYSLLATALALPDDGKILAMDINRENFEIGLPVIEKAGLAHKIDFREGPALPLLDQLVQDEKNHGTYDFIFVDADKDNYINYHKRLIDLVKVGGLIGYDNTLWNGSVVAPADAPLRKYVRYYRDFVLELNKALAVDPRVEICMLPVGDGITLCRRVS

SEQ ID NO: 324 - protein, 247 aa, Boehmeria nivea
  misc_feature (1)..(247): Public GI no. 55724835
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 679.6 for HMM based on sequences of FIGURE 14.
MANNGEGKQNEVSRHQEVGHKSLLQSDALYQYILETSVYPREPESMKELREITAKHPWNLMTTSADEGQFLSMLLKLINAKNTMEIGVFTGYSLLATALALPEDGKILAMDINRENYELGLPVIEKAGLAHKIDFREGPALPALDQMIEDGKYHGSFDFIFVDADKDNYLNYHKRLIELVKVGGVIGYDNTLWNGSVVAPPDAPLRKYVRYYRDFVLELNKALAADPRIEICMLPVGDGIPICRRVS

SEQ ID NO: 325 - protein, 242 aa, Nicotiana tabacum
  misc_feature (1)..(242): Public GI no. 1622926
  misc_feature (1)..(242): Functional Homolog of  Ceres CLONE ID no. 8049 at SEQ ID NO. 291
  misc_feature (29)..(241): Pfam Name: Methyltransf_3 Pfam Description: O-methyltransferase
  misc_feature (29)..(241): Pfam Name: Methyltransf_3 Pfam Description: O-methyltransferase
  misc_feature (1)..(242): Bit score of 667.2 for HMM based on sequences of FIGURE 14.
MATNGENGRHQEVGHKSLLQSDALYQYILETSVYPREPEPMKELREITAKHPWNIMTTSADEGQFLSMLLKLINAKNTMEIGVFTGYSLLATAMALPDDGKILAMDINRDNYEIGLPVIEKAGLAHKIEFKEGPALPVLDQMIEDGKYHGSYDFIFVDADKDNYLNYHKRLIDLVKVGGLIGYDNTLWNGSVVAPPDAPLRKYVRYYRDFVLELNKALAADSRIEICQLPVGDGITLCRRIS

SEQ ID NO: 326 - protein, 249 aa, Eucalyptus gunnii
  misc_feature (1)..(249): Public GI no. 1934859
  misc_feature (1)..(249): Functional Homolog of  Ceres CLONE ID no. 8049 at SEQ ID NO. 291
  misc_feature (34)..(245): Pfam Name: Methyltransf_3 Pfam Description: O-methyltransferase
  misc_feature (34)..(245): Pfam Name: Methyltransf_3 Pfam Description: O-methyltransferase
  misc_feature (1)..(249): Bit score of 677.7 for HMM based on sequences of FIGURE 14.
MATAGEESQTQAGRHQEVGHKSLLQSDALYQYILETSVYPREPEPMKELREITAKHPWNIMTTSADEGQFLNMLLKLINAKNTMEIGVFTGYSLLATALALPDDGKILAMDINRENYELGLPVIQKAGVADKIDFREGPALPILDQLIEDGKQGSFDFIFVDADKDNYLNYHKRLIELVKVGGLIGYDNTLWNGSVVAPPDAPLRKYVRYYRDFVLELNKALAADPRIEICMLPVGDGITLCRRIQLSI

SEQ ID NO: 327 - protein, 232 aa, Citrus natsudaidai
  misc_feature (1)..(232): Public GI no. 6561881
  misc_feature (1)..(232): Functional Homolog of  Ceres CLONE ID no. 8049 at SEQ ID NO. 291
  misc_feature (19)..(231): Pfam Name: Methyltransf_3 Pfam Description: O-methyltransferase
  misc_feature (19)..(231): Pfam Name: Methyltransf_3 Pfam Description: O-methyltransferase
  misc_feature (1)..(232): Bit score of 606.6 for HMM based on sequences of FIGURE 14.
MAKGHKSKLQSDALRQYILETSVYPREPESMKELREVTAKHPWNLMRTSADEGQFLNMSLKLINAKNTMEIGVYTDYSLLATALAIPDDGKILAMDINRENYEIGLPKIEKAGVAHRIQFREGPALPVLDQLVEDKKNHGTYDFIFVDADKDNYINYHKRIIDLVKVGGLIGYDNTLWNGSVVGPPDAPMRKYLRYCRDFVLELIKALAVDPRIEICMLPVGDGITLSRRIT

SEQ ID NO: 328 - protein, 246 aa, Eucalyptus globulus
  misc_feature (1)..(246): Public GI no. 3319278
  misc_feature (1)..(246): Functional Homolog of  Ceres CLONE ID no. 8049 at SEQ ID NO. 291
  misc_feature (34)..(245): Pfam Name: Methyltransf_3 Pfam Description: O-methyltransferase
  misc_feature (34)..(245): Pfam Name: Methyltransf_3 Pfam Description: O-methyltransferase
  misc_feature (1)..(246): Bit score of 673.6 for HMM based on sequences of FIGURE 14.
MATAGEESQTQAGRHQEVGHKSLLQSDALYQHILETSVYPREPEPMKELREITAKHPWNIMTTSADEGQFLNMLLKLINAKNTMEIGVFTGYSLLATALALPDDGKILAMDINRENYELGLPVIQKAGVADKIDFREGPALPILDQLIEDGKQGSFDFIFVDADKDNYLNYHKRLIELVKVGGLIGYDNTLWNGSVVAPPDAPLRKYVRYYRDFVLELNKALAADPRIEICMLPVGDGITLCRRIS

SEQ ID NO: 329 - protein, 247 aa, Parthenium argentatum
  misc_feature (1)..(247): Ceres CLONE ID no. 1605906
  misc_feature (1)..(247): Functional Homolog of  Ceres CLONE ID no. 8049 at SEQ ID NO. 291
  misc_feature (34)..(246): Pfam Name: Methyltransf_3 Pfam Description: O-methyltransferase
  misc_feature (34)..(246): Pfam Name: Methyltransf_3 Pfam Description: O-methyltransferase
  misc_feature (1)..(247): Bit score of 676.5 for HMM based on sequences of FIGURE 14.
MAAVNGGSDSQPAKHQEVGHKSLLQSDALYQYILETSVYPREPEPMKELREVTAKHPWNLMTTSADEGQFLNMLLKLINAKNTMEIGVYTGYSLLSTALALPDDGKILALDINRENYEIGLPIIQKAGVAHKIDFREGPALPLLDQMIEDEKFHGTFDFIFVDADKDNYLNYHKRLTDLVKIGGVIGYDNTLWNGSLVAPPDAPLRKYVRYYRDFVLELNKALAADPRVEICQLPVGDGITLCRRVS

SEQ ID NO: 330 - protein, 245 aa, Zinnia elegans
  misc_feature (1)..(245): Public GI no. 30580342
  misc_feature (1)..(245): Functional Homolog of  Ceres CLONE ID no. 8049 at SEQ ID NO. 291
  misc_feature (32)..(244): Pfam Name: Methyltransf_3 Pfam Description: O-methyltransferase
  misc_feature (32)..(244): Pfam Name: Methyltransf_3 Pfam Description: O-methyltransferase
  misc_feature (1)..(245): Bit score of 663.9 for HMM based on sequences of FIGURE 14.
MATPTGETQPAKHQEVGHKSLLQSDALYQYILETSVYPREPQPMKELRRITAKHPWNLMTTSADEGQFLNLLLKLINAKNTMEIGVYTGYSLLSTALALPEDGKILALDINRENYEIGLPIIQKAGVAHKIDFREGPALPLLDQMLQDEKCHGSFDFIFVDADKDNYLNYHKRLIDLVKFGGVIGYDNTLWNGSLVAPADAPLRKYVRYYRDFVLELNKALAVDPRVEICQLPVGDGITLCRRIS

SEQ ID NO: 331 - DNA, 1080 bp, Panicum virgatum
  misc_feature (1)..(1083): Ceres CLONE ID no.1756603
agccaacccgaggtcaatccagccacagcccacccagctcgtacccagatctcccggacccgttcagcgcctgctgtagcgtcggcgatggccagcacggcggccgaggcggcgaaggcggcggagcagccggccaacggcaacagcgagcagaagacgcgccactccgaggtcggccacaagagcctgctcaagagcgacgacctctaccagtacatcctggacacgagcgtgtacccgcgggagcccgagagcatgaaggagctccgcgagatcaccgccaagcacccgtggaacctgatgacgacgtcggcggacgaggggcagttcctcaacatgctcatcaagctcatcggcgccaagaagaccatggagatcggcgtctacaccggctactccctcctcgccaccgccctcgcgctccccgaggacggcacgatcttggccatggacatcaaccgcgagaactacgagctcggcctgccctgcatcgagaaggccggcgtcgcccacaagatcgacttccgcgagggccccgcgctccccgtcctcgacgacctcatcgccgacgagaagaaccacggcaccttcgacttcgccttcgtggacgccgacaaggacaactacctcaactaccacgagcggctgctcaagctcgtgaagctcggcggcctcatcggctacgacaacacgctgtggaacggctccgtcgtgctccccgacgacgcgcccatgcgcaagtacatccgctactaccgcgacttcgtgctcgtgctcaacaaggcgctcgccgccgacgagcgcgtcgagatctgccagctccccgtcggcgacggcgtcaccctctgccgccgcgtcaagtgagcgtggcccggcccggctgccaaccccaccgtaccgacgacggccgccgccgccgcccaactccaatcatagacgacgcgcagcattaattattcaccatcttttttttggctctttcttggctttgtaatcttggaaattgtaaccattttcgtgcgtaaatgtcgagaccataatactataaattcacagtaccacgaaaaaaaaaaaaaaaaa

SEQ ID NO: 332 - protein, 258 aa, Panicum virgatum
  misc_feature (1)..(258): Ceres CLONE ID no. 1756603
  misc_feature (1)..(258): Functional Homolog of  Ceres CLONE ID no. 8049 at SEQ ID NO. 291
  misc_feature (45)..(257): Pfam Name: Methyltransf_3 Pfam Description: O-methyltransferase
  misc_feature (45)..(257): Pfam Name: Methyltransf_3 Pfam Description: O-methyltransferase
  misc_feature (1)..(258): Bit score of 654.8 for HMM based on sequences of FIGURE 14.
MASTAAEAAKAAEQPANGNSEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIADEKNHGTFDFAFVDADKDNYLNYHERLLKLVKLGGLIGYDNTLWNGSVVLPDDAPMRKYIRYYRDFVLVLNKALAADERVEICQLPVGDGVTLCRRVK

SEQ ID NO: 333 - protein, 254 aa, Mesembryanthemum crystallinum
  misc_feature (1)..(254): Public GI no. 2995934
  misc_feature (1)..(254): Functional Homolog of  Ceres CLONE ID no. 8049 at SEQ ID NO. 291
  misc_feature (41)..(253): Pfam Name: Methyltransf_3 Pfam Description: O-methyltransferase
  misc_feature (41)..(253): Pfam Name: Methyltransf_3 Pfam Description: O-methyltransferase
  misc_feature (1)..(254): Bit score of 664.8 for HMM based on sequences of FIGURE 14.
MATTNVEENKQTQEQQPKEIKHQEVGHKSLLQSDALFQYILETSVYPREPEPMKELRDITAKHPWNLMTTSADEGQFLNMLLKLINAKNTIEIGVYTGYSLLASALALPDDGKILAMDINRENYELGLPVIQKAGVAHKIDFREGPALPVLDLLIEDAKNHGSFDFAFVDADKDNYGNYHKRLIDLVKIGGVIGYDNTLWNGSVAAPADAPMRKYVRYYRDFVMEFNKAIAADPRVEICQLPVGDGITLCRRIS

SEQ ID NO: 334 - protein, 258 aa, Zea mays
  misc_feature (1)..(258): Public GI no. 5101868
  misc_feature (1)..(258): Functional Homolog of  Ceres CLONE ID no. 8049 at SEQ ID NO. 291
  misc_feature (45)..(257): Pfam Name: Methyltransf_3 Pfam Description: O-methyltransferase
  misc_feature (45)..(257): Pfam Name: Methyltransf_3 Pfam Description: O-methyltransferase
  misc_feature (1)..(258): Bit score of 653 for HMM based on sequences of FIGURE 14.
MATTATEAAPAQEQQANGNGEQKTRHSEVGHKSLLKSDDLYQYILDTSVYPREPESMKELREVTAKHPWNLMTTSADEGQFLNMLIKLIGAKKTMEIGVYTGYSLLATALALPEDGTILAMDINRENYELGLPCIEKAGVAHKIDFREGPALPVLDDLIAEEKNHGSFDFVFVDADKDNYLNYHERLLKLVKLGGLIGYDNTLWNGSVVLPDDAPMRKYIRFYRDFVLVLNKALAADDRVEICQLPVGDGVTLCRRVK

SEQ ID NO: 335 - protein, 258 aa, Zea mays; identical to SEQ ID NO: 334
  misc_feature (1)..(258): Ceres CLONE ID no. 353929
  misc_feature (1)..(258): Functional Homolog of  Ceres CLONE ID no. 8049 at SEQ ID NO. 291
  misc_feature (45)..(257): Pfam Name: Methyltransf_3 Pfam Description: O-methyltransferase
  misc_feature (45)..(257): Pfam Name: Methyltransf_3 Pfam Description: O-methyltransferase
  misc_feature (1)..(258): Bit score of 653 for HMM based on sequences of FIGURE 14.

SEQ ID NO: 336 - protein, 267 aa, Glycine max
  misc_feature (1)..(267): Ceres CLONE ID no. 464460
  misc_feature (1)..(267): Functional Homolog of  Ceres CLONE ID no. 8049 at SEQ ID NO. 291
  misc_feature (54)..(266): Pfam Name: Methyltransf_3 Pfam Description: O-methyltransferase
  misc_feature (54)..(266): Pfam Name: Methyltransf_3 Pfam Description: O-methyltransferase
  misc_feature (1)..(267): Bit score of 658.4 for HMM based on sequences of FIGURE 14.
MATTAADATAAVPKEQQPANGSAAATTGGEQVTRHSEVGHKSLLQSDALYQYILETSVYPREHECMKELREITANHPWNLMTTSADEGQFLNMLLKLIGAKKTMEIGVYTGYSLLATALAIPDDGTILAMDINRENYELGLPCIEKAGVAHKIDFREGPALPVLDALLEDEANHGTFDFVFVDADKDNYLNYHERLMKLVKVGGLLGYDNTLWNGSVVLPADAPMRKYIRYYRDFVLELNKALAADQRVEICQLPVGDGITLCRRAK

SEQ ID NO: 337 - protein, 267 aa, Triticum aestivum; identical to SEQ ID NO: 336
  misc_feature (1)..(267): Ceres CLONE ID no. 700120
  misc_feature (1)..(267): Functional Homolog of  Ceres CLONE ID no. 8049 at SEQ ID NO. 291
  misc_feature (54)..(266): Pfam Name: Methyltransf_3 Pfam Description: O-methyltransferase
  misc_feature (54)..(266): Pfam Name: Methyltransf_3 Pfam Description: O-methyltransferase
  misc_feature (1)..(267): Bit score of 658.4 for HMM based on sequences of FIGURE 14.

SEQ ID NO: 338 - protein, 259 aa, Picea abies
  misc_feature (1)..(259): Public GI no. 96772920
  misc_feature (1)..(259): Functional Homolog of  Ceres CLONE ID no. 8049 at SEQ ID NO. 291
  misc_feature (46)..(258): Pfam Name: Methyltransf_3 Pfam Description: O-methyltransferase
  misc_feature (46)..(258): Pfam Name: Methyltransf_3 Pfam Description: O-methyltransferase
  misc_feature (1)..(259): Bit score of 654.3 for HMM based on sequences of FIGURE 14.
MASTDVAAAEVKAQTTQVEEPAKVTRHQEVGHKSLLQSDALYQYILETSVYPREPEPLKELREVTAKHPWNLMTTSADEGQFLGLLLKLINAKNTMEIGVYTGYSLLSTALALPDDGKILAMDINRENYDLGLPMIEKAGVAHKIDFREGPALPLLDEMVKNEEMHGSFDFVFVDADKDNYLNYHRRLIDLVKVGGVIAYDNTLWNGSVVAPPDAPLRKYVRYYRDFVMELNKALAADPRIEISQIPVGDGVTLCRRNY

SEQ ID NO: 339 - protein, 260 aa, Oryza sativa subsp. japonica
  misc_feature (1)..(260): Public GI no. 49618875
  misc_feature (1)..(260): Functional Homolog of  Ceres CLONE ID no. 8049 at SEQ ID NO. 291
  misc_feature (47)..(259): Pfam Name: Methyltransf_3 Pfam Description: O-methyltransferase
  misc_feature (47)..(259): Pfam Name: Methyltransf_3 Pfam Description: O-methyltransferase
  misc_feature (1)..(260): Bit score of 656.8 for HMM based on sequences of FIGURE 14.
MAEAASAAAAATTEQANGSSGGEQKTRHSEVGHKSLLKSDDLYQYILETSVYPREHECMKELREVTANHPWNLMTTSADEGQFLNLLLKLIGAKKTMEIGVYTGYSLLATALAIPDDGTILAMDINRENYELGLPSIEKAGVAHKIDFREGPALPVLDQLVEEEGNHGSFDFVFVDADKDNYLNYHERLMKLVKVGGLVGYDNTLWNGSVVLPADAPMRKYIRYYRDFVLELNKALAADHRVEICQLPVGDGITLCRRVK

SEQ ID NO: 340 - protein, 259 aa, Pinus taeda
  misc_feature (1)..(259): Public GI no. 4104459
  misc_feature (1)..(259): Functional Homolog of  Ceres CLONE ID no. 8049 at SEQ ID NO. 291
  misc_feature (46)..(258): Pfam Name: Methyltransf_3 Pfam Description: O-methyltransferase
  misc_feature (46)..(258): Pfam Name: Methyltransf_3 Pfam Description: O-methyltransferase
  misc_feature (1)..(259): Bit score of 647.5 for HMM based on sequences of FIGURE 14.
MASTSVAAAEVKAQTTQAEEPVKVVRHQEVGHKSLLQSDALYQYILETSVYPREPEPMKELPRVTAKHPWNLMTTSADEGQFLGLLLKLINAKNTMEIGVYTGYSLLSTALALPDDGKILAMDINRENYDIGLPIIEKAGVAHKIDFREGPALPVLDELLKNEDMHGSFDFVFVDRDKDNYLNYHKRLIDLVKVGGLIAYDNTLWNGSVVAPPDAPLRKYVRYYRDFVMELNKALAVDPRIEISQIPVLDGVTLCRRVY

SEQ ID NO: 341 - DNA, 2213 bp, Populus balsamifera subsp. trichocarpa
  misc_feature (1)..(2213): Ceres LOCUS ID no. 1461478
  misc_feature (1)..(2213): Ceres GEMINI ID 5217G1
  misc_feature (1)..(2213): Ceres SEED LINE ME23565
gctcccgtagtactagctagctggctgatcagagtatactatcaaacacaatgaggaagccggatctagtgggcaaagatagagtaccgagcaatagtagtattaacaaggccaaacttagaaagggtttatggtcaccagaggaagatgagaaactcatcaagtatatgttaactaatggacaagggtgttggagtgatattgctaggaatgctggcttgcaaaggtgtggcaagagttgccgtcttcgttggattaactatttgagacctgacctcaagcgtggcgccttttctcctcaagaagaagagcttatcatccatttgcacaccattcttggcaacaggtacttctttttttctttattcttctcttttatatataacggtcaaccaaataatgttttatatatttatatatataacattttaattatgtcaacaatcccagttgctggcgctgtttcgttttgtaaatacatcaagatactcttggatcgatcgatcatgcatggataagaaaaaaagaaaaagaaaaaggaagctcgcaattacttaaacaaattggtaatcagacctagtttaattacttgtaaattcacaagatatagtagtaccagctgtaacaaatgtgtagcgtagacaagttgcaataatgttaattattcatcagtttcgtgacgagaaaagtataaaaacctcccagacatttgtagatattaagtggatataatgtatagaaacattgaatgccagtaataatcatgcacattttgccttctctttatattattttcacctagaggcttcgaggagtttgtcagtgtgtgtgtagtgtgtgtgtgtgtgtgtgtgtgtgtatgctaaactacgtattaacttctcttaatttactggagtatgccattgctgccagctccagtgggtcatcaatttgatatgccttgtgagaatatatgtagtttacagttggttttataagtttgttatatggaccgaatagtttaccaacagtttacaaattctgatatgcctcttatttggactttccagcttcatttaatttgatcacccataaatcattaacgttctgcacaattttcgctgaatattctcatcatgttttaatccaaattggtccagtgcatgctataaaaaatcttaacaatagaaaagttaaaatgaacagttctgaaaaaacctcccacgcacacaaaaaaagagcactaatcaacttttgtcgccctttttttagaggtttcctttatgcctagtagaatctgttcagaaacaacaggggagataagaaaggaaatatatattctgcctaatagggagagaaataagcgtgtgctcatcccttccttttcagctttcagcataactaagatgcatgctttgaatatatatggatacgtgtttgttacagactcacagttatgtatttaaacaaagcaggtggtctcagattgcggcacgtcttccaggaaggacagacaacgaaataaagaatttctggaactccacattaaagaaaagattgaagatcaataacacttccacatcctcaccaaatgacagtgattcatcggagcctagagatcatgccataggaaatatcatgcccacgcatgatcctgacactatgactctatgcatggactcatcttcctcatcatccatatccatgcaaggtatgatcacaagcaaccgatttgattctttctccatgctcaacaaccgctatgatgtgactggtgcagcgagtttatttgacatgtctacatgcttgacacaagtgggtatgggagatggattttatggtgatcattatgggattttggaggccaataataaaacggggctagaaagtgatctttctcttccaccactagagagtagaagctttgaagagaataatacagtgagtaataacagaattggcatgaaaagcagcagcaacaacaacaacaactgctttgataatacttgcttcgataatacttgcttcaacaataatactgatcagagatttaaagtagaggacatgttggggcttgaaaatcattggcaaggagaaaacttaagaatgggagaatgggattttgaaggtttaatggaaaacataacttcctttcctttacttgatttccacgtagaataaccatctacccttacccccccccccccccccttctcataaagctacccttt

SEQ ID NO: 342 - protein, 251 aa, Populus balsamifera subsp. trichocarpa
  misc_feature (1)..(251): Ceres LOCUS ID no. 1461478
  misc_feature (1)..(251): Ceres GEMINI ID 5217G1
  misc_feature (1)..(251): Ceres SEED LINE ME23565
  misc_feature (78)..(123): Pfam Name: Myb_DNA-binding Pfam Description: Myb-like DNA-binding domain
  misc_feature (1)..(251): Bit score of 644.2 for HMM based on sequences of FIGURE 18.
MRKPDLVGKDRVPSNSSINKAKLRKGLWSPEEDEKLIKYMLTNGQGCWSDIARNAGLQRCGKSCRLRWINYLRPDLKRGAFSPQEEELIIHLHTILGNRWSQIAARLPGRTDNEIKNFWNSTLKKRLKINNTSTSSPNDSDSSEPRDHAIGNIMPTHDPDTMTLCMDSSSSSSISMQGMITSNRFDSFSMLNNRYDVTGAASLFDMSTCLTQVGMGDGFYGDHYGILEANNKTGLESDLSLPPLESRSFEE

SEQ ID NO: 343 - DNA, 1552 bp, Populus balsamifera subsp. trichocarpa
  misc_feature (1)..(1552): Ceres LOCUS ID no. 1520476
  misc_feature (1)..(1552): Ceres GEMINI ID 5217C1
  misc_feature (1)..(1552): Ceres SEED LINE ME23567
attttatgggttaataacacctttccttttccaattgcaagcaaaaacaaatggcaacctcaaccaatgaggaagactatcatctccagtatgctatgcaactttcaagtgcatcagtgctgcctctggttttgaaagcagcaatagagctaggtgtgtttgagataatagaaaaggctggtccagatgccttgctctcagcttcagatattgtcgctcaatttcccacacaaaacaacccggtagcccatattctgctagaccgtaacctctgcctgctcgcaagccattctattcttacttgctcagtgtccaccaagaagattcaggatggtcattcccagaggttatatggattagcacctgtggccaaatactttacgaagaaccaggatggaggatcgttgagtccctttttagctatgattatgatggatatgtggtaagagacttcataagtattgcttctttcatatattctatttttgttgtcgaattgtttgttgctatagttagtttgtgatttttcttcttctttcactatgaaataacaacaggtaccacttaaaagacgcagttctggaaggggggattccatttgaaaaggctcacgggataaattctgcagaatatctaaaaaaagatgcaagattttgtgagctattcagcagttccatgaaaagtttcaacgttacatttatggagacaattctggacatatatgatggatttgaaggtgtaaaatgcttggtggatgtgggtggtggcaatggttctatccttaacatgatcattaccaagtaccctgcaattaagggtatcaactatgatttggcttcagttgtggaaagctcaccatcctacccaggtattgatcttttgttttgatcttttattttaacttattacttacatatcgaaaggatgcttgcctattcttgaagttgaaacgcgactagtaggaaaactgcattgatacagttgtttgatcatttacttaaagtgtacaaaattgagcagtctgaacaagttttgttctgtaggaattgagcatgtcgcgggggacggattcgtaacaattccgaaaggaggagatgccattttcatgaaggtaataagatttgatactagtgaagttttaacaaattgttagctacatacctctgttagggaactgaaaatgatatttttgaatgaaacagtggataactcacaactgggatgatgagcacttgctaaaactgctaaagaattgttatgaagctttaccagacaacggaaaagttatagtggtggatatggtagttccagaaacccctgaaaccaatgttaaagctaaaagcatgctacagaattatttgttcataacaagcatgagtccgcaaggaaaagaaaggacagaaaaagaatttgaaaccttgggaaaggaagctggattttctcatattcgagttgcttgttttgtttgtaatttttcagtagtggagtttataaaaaaataagtgcataattactgttgtagttacatcagcttacccaattgctcatgtgg

SEQ ID NO: 344 - protein, 251 aa, Populus balsamifera subsp. trichocarpa
  misc_feature (1)..(251): Ceres LOCUS ID no. 1520476
  misc_feature (1)..(251): Ceres GEMINI ID 5217C1
  misc_feature (1)..(251): Ceres SEED LINE ME23567
  misc_feature (26)..(78): Pfam Name: Dimerisation Pfam Description: Dimerisation domain
  misc_feature (89)..(251): Pfam Name: Methyltransf_2 Pfam Description: O-methyltransferase
  misc_feature (1)..(251): Bit score of 800.3 for HMM based on sequences of FIGURE 19.
MATSTNEEDYHLQYAMQLSSASVLPLVLKAAIELGVFEIIEKAGPDALLSASDIVAQFPTQNNPVAHILLDRNLCLLASHSILTCSVSTKKIQDGHSQRLYGLAPVAKYFTKNQDGGSLSPFLAMIMMDMWYHLKDAVLEGGIPFEKAHGINSAEYLKKDARFCELFSSSMKSFNVTFMETILDIYDGFEGVKCLVDVGGGNGSILNMIITKYPAIKGINYDLASVVESSPSYPGIEHVAGDGFVTIPKGG

SEQ ID NO: 345 - DNA, 1424 bp, Populus balsamifera subsp. trichocarpa
  misc_feature (1)..(1424): Ceres PROMOTER Pt4CL1
ggtagttgtgattgagatatgtccagcactagttttttgttggtgtgatttctcatgatgacgggaaaattatatatataaatgaataatatttgtcggaatgatttgtttataaaataggttttgtagattcatgttagatatacatactttgtcaataagatatagctttaaatattgttcttttctttgaaaaaataaattagggtcttgaactcgaacccttttgcggaaaaaatatattaatgtaaaatttaattttattgtttttttaataatttgaatgatgaaataaaaatttacttgacccgttcatattatggtaaaatccatttaatcaaggtaacttttgtgtttagcccttggctccaaatattttacactctcatatgtgagtaaattataaattattctctctaattttgtaaaataaattaaatagttcatctagattcaaaaactaattaattattctctttaattttgtaaattaaattaaaaagatcagagtgaggtgaccagttgtcaaattactactcgacttggaagcatcacaactcaatttaaaaactagatttaaaaagatttagattattaaattatcaagttaattcacgggttgtctaatcaattgttgttaattaaaatgatagtatttttgataatttaatcaaatttttattggatttaaacaagtcaattaaatcacaaaatatcttattaaattaatatcttatttgatataactagaaatataacatgattaacctctaaaaatctcaaatttctcttataaacttgtataattgggctagatttaacggctattattccaactcgccaagacaactattaaaattaattaaaaaaaattctaataaagcacttcctaattgttaaaatacatgtctaaacactaaattagtaattttttttttagtttaacgtggatgtccgagtcagtttacgcgtacctcaactaaatttgtattttaatttttaggcagtaggtgagagaggagaggcacaagtgctgacaaataaattagtgcataaaatataatggatcggtggtctgtgaaaggacaggtggaggacaagccaccctctctcaagtcaaaaggccactttcataaccaacccaaatgggaacccaccaccgttcctcgccattaaaaccctaatctcaccaacccaactccacagattcttcaccaaacgcaacccatttttcaatcaatgttttccctatattaccccccaacaactccataatacccaatttgtcctttcaccaacccccgccctccatgccaaccaagtctatatcagcatgagtgctctgcactctgctttctcaggtctcctaccataaaaaaacagagagcacctaaaactcaccatctctccctctgcatctttag

SEQ ID NO: 346 - DNA, 1413 bp, Populus balsamifera subsp. trichocarpa
  misc_feature (1)..(1413): Ceres PROMOTER PtPAL4
tgatggaacgtccaagagataggctacagatgtaaaggtatgcacaaaaaaaaccaaaatggctttcaaattgtcaagtaatcaatggagtctgggaaaaagaaatggctaaagagctccacattacaagtgaagaacggccggccatgagttgaatacttcctgttaatggttaccttgagttcatcaaaaagtgatattattttaattttatttttttaaaattaaatttagtttcgattgagttatgaaataattcaccatgttatttgtatttgactagattatctccagcctgatttttttgcacccggtccgagatagttctaaatttagccaggaagcacactgttcaggccgttttaacacgcaagtagcaaaaagaagcacatgattacaattaataaattttgctcgagttttcttctataatatttttgcctggcattgatccagccgacatgattcttggatttaccatgcactcgcaatgaaaaatcacaacttgatataattaattaatataaaaaaagaaatacctaacactaaggccgagttagaataatgcccaagtccaatagcttgcatgcatcaacttgaaagctaggatgacgggaaattttataagaaataaaagagaaactgtagaaattcaaaacaatccggaaatatctcatgatatataattatcactatttattttttaaagggaaaataactaacaaaatcaatcgagttacatagcatttccgcgtgtagataaataaagaaaaaaaatggatttttttctattttcaagtaaagatatgcatggatgtgttcgttgtaattccctctgccttttaggtagatatggtgatttaaatttcatggcagaaaaatcattgattaaataataagaattagagccatgacgtagtgctgatgtgccacttctcaacaacccccatttctccccaaccttctatctttttgacaagaacaggaaatcctccgaattatgggacccaacttaagtgcatgctacttaccacaatatcccaagtgtcacaatcccacccattgaatcccatgataatccaacggccacgtacacttctcaactaacacatcggccaacccaccccaccctctacctgcctgcccctccttccttctctatttaaagcacctaaattttggtgaacaaactcaggatttttgggtaacctgaaaattcctacatacatttagagcctcgcaacttcaattttttcttactatacaaccctcatataattttttacgccagaaaattctttgtgctcacacatccgttcttctctctcattttctctttgatcataccaatcgatccatcactctttttttgtctctcccccattttggcatagaggatcatcgctttacagg

SEQ ID NO: 347 - DNA, 1075 bp, Populus balsamifera subsp. trichocarpa
  misc_feature (1)..(1075): Ceres PROMOTER PtHCT
aagtgctacctgcatgtctatgatgttgctaaagttattctgactcacggaaggacagataaattttataaaattcgctagtgatttatatattattttaagaaaaaagaaacttgaaattaaattaaattttgattaagttgtgaatttacttgttgagtggattaaatctaataagataaatttgcttgcgcgatgaaatctcaccagcttgatctgcttccaaaaataccaaacagttttcttagctaataaagataaagttggtgtgatgctttggttatcgtgagagtgatgaaaagtcaatgtcataaggctggggttggtgagcaccaataaaaaattgaaaaaactaaattgctcctcacagattcactataaggtgtccctccaacatccttcttggaaggtggcgactccattgacctttgttcaccctctctcgaaccctccttttgtcttcgatattctctctacttctctgctctaggctcacaggtatgctacctcttcatgtgtttgttcttgatttaattcttgcgtccttttttttctcttctttgggtttttaagcaaacaaggtcgtttaaaaccgaagttagactaataaatgcatgagttaaagggttgatttttatggtttttaagttattaaatacttctgtgccattgtactggggaagatatggatacattgattttgtgttttaagtgatagtgataaagatgcatccagttccttttcttttggtttagaagttatggttgatggagtcattttcagattgtaagatttaagagggaaaaaggaaggccttttctttttttggtgtttcaaatcggttctacaacagaaagatttcatttttcactatttattaatgccagccactgcatttaaatgtgcaaccaccaagaactttttggcacataaacaggctggggctggaaagggtaacgatcacaatttaaaggatatccattatcaatttgtgacaatttgtctttgaaactgcagagaacttggggtggaagagggatagaatcgataaatagagcattagcacggggaaag

SEQ ID NO: 348 - DNA, 1555 bp, Populus balsamifera subsp. trichocarpa
  misc_feature (1)..(1555): Ceres PROMOTER PtF5H1
ggagagatatgaggacaattcttcaacctgtccggatctcgatctgaatttgtgattgaaggcaggttcgtccgatggacccgatagaaatcaggtgtacggtctctttaacactacggccaaggacttgcggacagcctgcaatgtttcagttgttggatgctagtaatcgatttggagcactcaaactccagagttcaaggtgattttagaccaacaagttcaaacttgaacgacctaacttgttttttataatgagcaactcaatgttgagatggccgaacttagctgatttataatgaagatgagatcacagatgggtggtatatgtgccctcttttattgggctcacggtccttgtgaagaccctcctcatcctccagcgcctctattctaaattaattgtatttgaacttataaatgtttaaatttataataaatattttattgttatattaatttattttattttaattattatgtacttatttttaatatatatatatattattgacggtgttaccgaaggattaagtttgttggtatattctagagagttgaaaaataattactgcaaatgtcactcccgctatttaatcaccgacagaattgcatatggtctttctgttggttatatgttagattcaccaatgaaaataccgacgatgaaaaaaaatcatcgatggaattatatacagtttttttgttggtaatatattatattcatcgatgaaaatatcaacaaaatgaagcaggtaaaatgaaaatatcaacaaaataaaaaaaaatttaacgggcttttgtggtccgtaaatccatcaataaacgtattactaataaactcatcgacaaaccacaaatgatcaatgagaggtttttttatagaacatttttatccattaatgtcgatatactaaaagtataaataatgacagaaaatttggtcggtagtggttattttgacctcaacatgtgagctggttcactatatatataggtgaaattgttctgtcttgttttcgtttcatctccgtccagattttgtatgagagcttatattaaatcatagttgctattttgtaagaaaatcatacatgttttttgtgaatttggcaattagaactatgctgattcaaatatattcgataggaggtatatttggatggcctccatgtgcctgatccaaaaatatcgaaaaaaagaataggaaagtcattaattaatgggcctaccttctctccttatttatagaaagtctacacttgttttcaacctttcacaagagaaaatataaacttatttgatttcagcattgaataagtaaacaaattcttttacaaattggagacgaaaccttccaagataatttaagataattaaataaataaaaagtggccaacttgtgaaatgttcgagacaggccacgaaaaaaatctatataaagcccatgatatccctctcaacttagcagcatcggaaagttgcgaggagtaaagtcttgtggattacacaaaatacagactgaaaacatccataggcaccaacacataaacca

SEQ ID NO: 349 - DNA, 1481 bp, Populus balsamifera subsp. trichocarpa
  misc_feature (1)..(1481): Ceres PROMOTER PtCOMT
ccacccatgtcattaatttaccaaactcctaacacaatcatgtttaataacccttcaattttcaaaaataatttcagttcttatatttatttttatttgcaaattagtccttgtttgaattttctttttagttcttatactttacaaaaattatagtttatttttttattgtgattctttttattataattaaggtccctacatgcttttttttttatgtaatgctttttaatgtaataaatcattctgattgtaatcatcaattatataattattttgacaattacataattaaatatagaaatataataaattattacgttacatgatctattactaagtacccaagtctctacgtcaatgttcaattttcagcaggtggttctgttagaatgtcccatccaaaatatggattcattgatacgatttttaagtccaaacaaccctcatattaagcaaaaccctcatattaagcaaaagttattattattatttattattattattattgtttttgttgttgtgcttcttctttttctcaatcaacaaaatttttaccaacttcaagatttttttttttatggttaaaggtatactaatatgacctaataacttagaagtgtggattatagataaaattagcaattcgtgctatatagtgggttggatatttatttatataaaaaaattatatatataagtttttttttatgcatacttgtacaaaaaaaaaatataaatacaaatcaaatatttattcaatcaaatgataatagaaccagatatatatgaaattgattaaaaaaaatatatcatgttaggtcaacatattagaaatactatacaaaaataaatatttatatgtatataacacatacaaagattttctatagcgtgtgtttattcagtgagtttcatttatattaactttaaaatcattagttttataggatgtaaatttatcttttattaattttaaatgtgttcaataaatacaatcgggtgaatgtatcattatgtgattgaatatcttaatctgcatttatcttttaattttttcagttttttttttgttattgttaatgaatttttttttatttatataaatgattattgatttatttaattagatgctttatactttaattttttttatataaaaaaacatattaaaacaatctatatacctgatatttttatttttaaaaattataacctatgataaagaagttttataaacctacctgcttgacataacacatcatgttccaatagtctcccctgaaacaggttaaaaaaaaaaaagtttggcaaataagacgaggaaaaatatatagaagaaaaggtagggagtcagttctaggaagaagacatttgtgcatcaagtagagagtagggaccaaccacaaggtggttgagcacttcaccatatatagcaccactttgcaacctctttttcagtattctcatatcctcttcac

SEQ ID NO: 350 - DNA, 1458 bp, Populus balsamifera subsp. trichocarpa
  misc_feature (1)..(1458): Ceres PROMOTER PtCCoAOMT
tgctcttttcttattcacgatagaagtctgttcagttaaagaaaacatggcctgttttcctagaaatttatctataaaaaaggaaattcttgttaaaataaagaaaaaaattcaattgaaatacacttcccagctttcgaatgtttctattatattttggaaaacatgtgaaaaatattttattaatgttcacttgaaaaaatggttatggttgcttttcaaagtgttttttacttggaaatgctttaaaataatatttttttattttttaaaaatcatttgtgatatcagcgcatcaaaatgatttgaaaacattaaaaaatattaatttaaaacaaaaaaataaaataaaataatttaaatttttttaaatacttttaaaacataaaaaaaaaaacagaatagaatttagacataaaaagtgttattctcgtcgtttaatagcgggaggtggtaagaaacatgctaagcattcacagttttggatattgattatccatgtgttaccctaaaaactgcctttttccatttcatgaaatcctcatttaatagcaattctttaaaggaggagactagagacagaggtggctgctgtcaacctagtcggtgaatttaaacttcaaccggcacatatatgcataccaagtataccctttacatctgccctaattaagactgtaaaacggatttggatttttgccgacaaaggctagtttgtggagaaaaaacaacgaagataaatttttagatgacaaagtcaacaatagttcgagagattctttaaaggactcatccgttgacggaggtggccatatgctaccaactcttggacgtggagtccctttggtaatttcacctatccctcacccaatttctattagcagttagcacatgtaatttatgattggtgagcccagcacaaatcttttccagttaaacacatatattaatttatgattaattatttaattctctccactcttaacaaattaatcatacatggcataacattttagcttttgatctcgagaatctctacctaaccattgacttctttactgttcaggaatcttagaaaaaaggaggacaaaaaaaaatatgcccaataaattatttaagaatttgaaccgagatttggtgtcatagatcccaaaaatgacgtcagcgatgcctcagggaaggagtaccactagcccacagcacgatacgatcaccaacaaggtgggtcccatatttggtgggccaaaaacccacattatccttcgtcctaactacaggaacctcaccaaccccctcccggttggtagccggtccagcctccccgctactccaattcaaaccgggctctcatttccaataaataccacccgccctttaccattttcgatcaggttaggcatcactaccatcatcaacaacaaaaataaaaattccaaggccaagaaagagatcgtagtt

SEQ ID NO: 351 - DNA, 1212 bp, Populus balsamifera subsp. trichocarpa
  misc_feature (1)..(1212): Ceres PROMOTER PtCAD6
ggttttgagttgatttaggttttgaggcattttttttgtggtttttagaggccattgattagtctaataaggttcttctccataatttttcttgcttatttatcattttttaaatattaattttttattattatatttggtgtgtttaattcatctataattttttatatatatattttacatatattaaacttactttaaaaattaaaaatgtttatttttttataatatttttaatatgtgcaaccttacaatatctttccttttattatattcaataaattttccacgtgaatcgatttttattataaaaatattttaataaacaaattcattatacataatcggataaattacccatattacgatattaaatattttgatttatatttgtttcttgttttgtttttatcataaatttattttttttattgaattatcttgaattgatgacgtaggaaacatgataaacatgtaatctagatatatctcatgtctaggtcatgggtttcacgtgttagttcagctttacccaaaataatttttttatttgttattattgttaccttattttttcatcatattattaaattaattaaaatttaatcaaaacattaattttttcttacttttttttaaaatataatcttctcttaaatttcttttttcatgtttaaaaaaatttcagtcgacggcacaacaatccagtaaataccaagggtatattgtcgccactcaccaccaactacgtcaattaagcaaataatataattaggcaactgtgtaaccaccatggaaattaagatattcctttcatgaaatacttaattagtgacgtatacatgatgctccaaacctcatcacagattcagtgttcttaactattatgttcccttttgtttcccaagaaccatgagttaatcaggaccatcgatactactgaggccccaccaatgttttgatcatgtggacaatgttcacttgattttcaactttgaagaaatgacccatggttgtggaagcagaggatggcgccactccatcacatttcacctaccaccacccgtaaaatatgcggagctgtccttgtcttttttgttgccaagtaacctttgccattctttatttgtgcttttgtatatatactcatccatagtggcttctaattcttcaactctccacagaaactccatctctctctcttagcctcat

SEQ ID NO: 352 - DNA, 1479 bp, Populus balsamifera subsp. trichocarpa
  misc_feature (1)..(1479): Ceres PROMOTER PtC4H
caaagtaacggtaaagtctagtcggctgtttaatggttgacttttctttcttttcagttatttcaattgaggattgatttcttccaaatttcgactttttcctcaaaacatgtttaacatttgcaatttgcacctccgcaaaacgttgatgacattcacagcatagcatgacaccagtcctttgaactaggatgataagcttgttccttaattaatttattcaaactagttagattttgtagcattgaaaataaataaattattttcttaattaatcggtattcctcaatttaataatttattttattaaaaaaacccatttcgccgttaacctttttttatttactctattctcttaataaaacaaaatacaaaatgaaatgaaaaacgggaaagtatttttaaatgctaaatgtatatatacccaataaaaatgtaagttaccaagtatatctaaaataataaattaaattaattaatttaatcataaacattaacccattaattgtattgatattagccatttaaattttatacactacaattaaaatttaattggctatatcaataaaatttattaattataaaaacacctataattaattataatttgagatcaatattctaacatgagggagtattgacgaagccccgattaatgaatattcttgaagtgtgtgtatatatacatatatgtatgtgtaaaacctgttggcataaaataaaacccgagttatgtatgaagaggaattctttgatttttgttaaaggatcaaaataatattgatttgaaaaaaaattaaaaagaatagtgaatggaataagtggagatcattttggattcttgaatgtgttagttagttttttttattttttaacttaaatcaagtgttttaaattaatcctaaaaaatataatttaattggccagattctgaatttagttcttagagatcattaatttaaatgctataaaattcaagattattaaaaatttacataaaaattaactttaaaattttaaaaaattaatcaagaaatataaaaattaactcagaaactacggtaaaaaaaaataaaaataataaggtcttgtattgagatgaagagagtcgcgcttgtatgcgtgtatatatataaggaatttgtgacatcatgtgcctcacctactacctctacaacgatcaatgctgtgttgtccctctcctatcacacctcagaactaacgccgttaactctgtttcagaaacctaactggaagccacacgtccacctaactcatgaactatctttatctccaaccttccagttgctctttaattcttctactgcttataaaaccccctcccaacccccactcactccccaccaaccacctagtctctcctcctcttaattatattttcttcaatctaccactccttcttctccccagaaatctctttcagtactcctttggataaagaagatcatattccag

SEQ ID NO: 353 - DNA, 1541 bp, Populus balsamifera subsp. trichocarpa
  misc_feature (1)..(1541): Ceres PROMOTER PtC3H
ccttgacactttaccatcctcacccattttttaccaaattcaccatccaaatatcatatatataaaatcttgtgttgttgttttttacttggtggatttgagaccacgttagagcccgatcttgctgagggtttagattatcgagttaatctgtggattaattttaaaataatattttttagatagtttttttttaataacattattttaaatataaattaaaaaaaattaaaactgattcaattaagtttcttttgagatttcttgattgagtttgacttatcaagttacctaaatttaatatacaaattgacttgaaagcaaatctaatctaagttaggttttaagagtccatttagaaacatgtatccttaaattttgaaaaacaaattattaaaaattattatttttatgtactgatctcaaaaataatttttaaaaaataaaaaatattattttgatgtatttctaagctaaaaacacgttgaaccgcaatcaccattacaatttcaagcttaaaatacattaaaatgtgtgattgtgggagtttgggagtgtgattatggttacttttcaaagtatttttcacttggaaatacattaaaataatattttttaaaaaaaattatttttaatatcagcacattaaaaatatctaaaaatactaaaaaaatattgtttttatacaaaaaaataaaaaataaaaatatataatttaaatcgcattctcgaacattacatatctcccggtccagccgtcaaaagcaacttttaaattatataatagtagtagataacattatgtgccccgtaattataaatttctatagcaatttccctctcaattattacaaaccttttaacttatcttattttcttaattacaaatatgtgggctgcgagaaatgaatagaatggtctcccccttcaccaacttttgattcctccttctttgcttgttaaaaagtctcacttcaccaaccaccaaatactaaaaaaaacaaaaaaacaaaaaacccgctctactatcttttcaccgagagtgaagtcacgcgccaccgttcttgagcacgtgggacattgtaattggtcaatgtttccccacaatgggcattgacaagtgacacttttttcccctccctctcctatgacagcgactataagcagaagcaaagagtcgcacatcgtccctcaacttcttaaatttattcatgttagaccctcttctttaagtttgatcaaactcactactttattctcaatgaaatgcattcttacctcgtgaaaaaactcaattattaattaaatgacttgaatgaacatctgaaattggatttgtatgaaagtaaaaagggtttatttgacccaatttaaagtgagggattgagttggtaatttgtggaaattagagggaccatgaatgatttttaacaagaaacaaaatccactcaccaactccctccctcgcagagaccaactccattcctacaatttatattctgccaaggcccttcagaaaaattagaccctttctctccctt

SEQ ID NO: 354 - DNA, 1232 bp, Populus balsamifera subsp. trichocarpa
  misc_feature (1)..(1232): Ceres PROMOTER PtCCR1
agatcatgtccttcatcactcctttgatgaaaatgctggtctaaataaaaaacacacgttcaataaaaaagaaaaagagaccaggtcaatcagtgggaagagaagagaactggacgtaagaaattgtcaaagattcatatctttgaagttactaggaagggaaggactctcaggtctttctttatacatgcaagaaacaagaaacatgtggatatatagattataaactctctctctctctctctctctctctctctctctatatatatatatatatatatatatatatatgatttgaccaaaaggtaaacgttgttggtcatgagcattcttgaatagagaaattaaaaaagaaagaaaaaaacatggatggtgatttacttattcttgtacatatatagattcaactatgcatttccataatcaattattgtattttgttttgtaattatccgagaaaaactatgttgactgtacataaatatgtttgatgaaccaatttttttatcgtatccaaataataataaaaataataataataataaaggtaaggtaaaaaaatatatagtaatatccttggagatttcattattttcgatacattcatatattaatagaacaaaaattggttgttcggaaattaattacaaatatatgttttgaataataccaaagtaaatgccaaagaagaacaagagaacaacatgcacttttggtccaaaaaatacatacataaaacaataagttttccatgtaagatttattagtagcttattctttaacatgaacacttgtcatccatgagatcctttccctctctccttccaaaacaaattaaattaagtactgctctctacttgtgatcaacaaccatttaatgggtcgttgtgtataatatattttcatttcttaatttattagtagcttataattacattttggtcaaaaacagcatgcacgtttggtaaaaaaaacacatgtacaaaacaatcaggattccacacatggtgctgacgattcatatcacaaaaactcagtcacaaacctcaaggaaagaaaaataatggaaagagagaaactctctttggtaaatatttaccggtagtgggtgaggaaggtaactctaaaccttaattataaatacatccactccaccacttctttccttgtagcagccacctcctaaatcaagagaaaaggaaaacacctccctctctctgtctctcttcctt

SEQ ID NO: 355 - protein, 317 aa, Citrus sinensis
  misc_feature (1)..(317): Public GI ID no.146217453
  misc_feature (1)..(317): Bit score of 381.8 for HMM based on sequences of FIGURE 18.
  misc_feature (12)..(58): Pfam Name: Myb_DNA-binding Pfam Description: Myb-like DNA-binding domain
  misc_feature (1)..(317): Bit score of 381.8 for HMM based on sequences of FIGURE 18.
  misc_feature (1)..(317): Functional Homolog Of Ceres ANNOT ID no. 1461478 at SEQ ID NO. 342
MAFNRREVDRIKGPWSPEEDEALQQLVQKHGPRNWSLISKSIPGRSGKSCRLRWCNQLSPQVEHRAFTPEEDEMIIRAHARFGNKWATIARLLNGRTDNAIKNHWNSTLKRKCSSMLTENGIFLNCNGYDADFGNSIQQQPLKLKRSVSAGSSVPVTTGLYMSPGSPSGSDVSDSSVPGLSSNYNIYKPVARSGGINVDVNVVPEPETTSSSNDPPTSLSPSLPGVDSSSEVSNKVSESTQAVNAKASVPAPVSSDSGSKGLVGFSKEFMAVMQEMIKQEVRTYMAALEQQRGGACYNGSGGGGDGVLRNVAMQRTG

SEQ ID NO: 356 - protein, 314 aa, Pinus taeda
  misc_feature (1)..(314): Public GI ID no.34147924
  misc_feature (1)..(314): Bit score of 562.6 for HMM based on sequences of FIGURE 18.
  misc_feature (19)..(66): Pfam Name: Myb_DNA-binding Pfam Description: Myb-like DNA-binding domain
  misc_feature (1)..(314): Bit score of 562.6 for HMM based on sequences of FIGURE 18.
  misc_feature (1)..(314): Functional Homolog Of Ceres ANNOT ID no. 1461478 at SEQ ID NO. 342
MSCTTGGLSSPVSKPKLRKGLWSPEEDDKLINYMMKNGQGCWSDVAKQAGLQRCGKSCRLRWINYLRPDLKRGAFSPQEEHWIIHLHSILGNRWSQIAARLPGRTDNEIKNFWNSCIKKKLKHLSASTNNSKSISAPNRTSTMNSSITPFSESSAEPLEVMATRYQPSNAFNHEVPTAENQFCIPDVLALRHEQVQSQNQFSIDQDSATNNLISHLWNSNSTAVSSHESFSHAFMSPGLQTQGHVVKTPIKPCDQISWSTPLTREAAGSHACNYSLGCNIPALVESETLKEKFKNDAGDQINENEIMYLPRHLL

SEQ ID NO: 357 - DNA, 984 bp, Populus balsamifera subsp. trichocarpa
  misc_feature (1)..(984): Ceres ANNOT ID no.1440199
  misc_feature (1)..(984): Encodes the peptide sequence at SEQ ID NO 358
atgaggaagccggatctaatggccagagatagagtgccaatcaataataatatgaacagggccaaacttagaaagggcttatggtcaccagaggaagatgagaagctcatccagtatatgttaactaatggacaagggtgttggagtgaaattgctaggaatgctggcttgcaaaggtgtggcaagagttgccgactgcgatggattaactatttgagacctgacctcaagcgtggcgcattttctcctcaagaagaagagcttatcattcatttacactccattcttggcaacaggtggtctcaaattgcggcgcgtcttccagggaggacagacaacgaaataaagaatttttggaattctacattaaagaaaagattcaagatcaacagcacttccacatcctcaccaaacgatagttctgattcatcagaacctagagatcatgtcgtaggaaatatcatgcccatgcatgatcatgacgttatgactctgtgcaaagactcatcttcctcaccatccatatccatgcatggtgtggtcacaggcaaccaatttgatcctttcaccgtgctcagtaaccgctatgatgtgagtggtgcagcaagtttatttgacatgtccacatgcttaacacaggtgggtatgggagatggattttatggtgatcattatgggattttggagggtaataataaaatagggctagaaagtgatctttctcttccgccactcgagagtagaagcattgaagagaataatgcagtgagtaataacagaattggcgtgaaaagcagcagcaacgacaaccaccactttgatagtacctgcttcaataatactgatcagagatttaaagtagaggacatgttggggcttgaaaatcattggcaaggagaaaacgtgagaatgggagaatgggatctggaaggtttaatggaaaacatatcttcctttcctttccttgatttccaagttttataa

SEQ ID NO: 358 - protein, 327 aa, Populus balsamifera subsp. trichocarpa
  misc_feature (1)..(327): Ceres ANNOT ID no.1440199
  misc_feature (1)..(327): Bit score of 632.2 for HMM based on sequences of FIGURE 18.
  misc_feature (78)..(123): Pfam Name: Myb_DNA-binding Pfam Description: Myb-like DNA-binding domain
  misc_feature (1)..(327): Bit score of 336.5 for HMM based on sequences of FIGURE 18.
  misc_feature (1)..(327): Functional Homolog Of Ceres ANNOT ID no. 1461478 at SEQ ID NO. 342
MRKPDLMARDRVPINNNMNRAKLRKGLWSPEEDEKLIQYMLTNGQGCWSEIARNAGLQRCGKSCRLRWINYLRPDLKRGAFSPQEEELIIHLHSILGNRWSQIAARLPGRTDNEIKNFWNSTLKKRFKINSTSTSSPNDSSDSSEPRDHVVGNIMPMHDHDVMTLCKDSSSSPSISMHGVVTGNQFDPFTVLSNRYDVSGAASLFDMSTCLTQVGMGDGFYGDHYGILEGNNKIGLESDLSLPPLESRSIEENNAVSNNRIGVKSSSNDNHHFDSTCFNNTDQRFKVEDMLGLENHWQGENVRMGEWDLEGLMENISSFPFLDFQVL

SEQ ID NO: 359 - protein, 344 aa, Arabidopsis thaliana
  misc_feature (1)..(344): Public GI ID no.116831188
  misc_feature (1)..(344): Bit score of 551.9 for HMM based on sequences of FIGURE 18.
  misc_feature (85)..(130): Pfam Name: Myb_DNA-binding Pfam Description: Myb-like DNA-binding domain
  misc_feature (1)..(344): Bit score of 551.9 for HMM based on sequences of FIGURE 18.
  misc_feature (1)..(344): Functional Homolog Of Ceres ANNOT ID no. 1461478 at SEQ ID NO. 342
MMMRKPDITTIRDKGKPNHACGGNNNKPKLRKGLWSPDEDEKLIRYMLTNGQGCWSDIARNAGLLRCGKSCRLRWINYLRPDLKRGSFSPQEEDLIFHLHSILGNRWSQIATRLPGRTDNEIKNFWNSTLKKRLKNNSNNNTSSGSSPNNSNSNSLDPRDQHVDMGGNSTSLMDDYHHDENMMTVGNTMRMDSSSPFNVGPMVNSVGLNQLYDPLMISVPDNGYHQMGNTVNVFSVNGLGDYGNTILDPISKRVSVEGDDWFIPPSENTNVIACSTSNNLNLQALDPCFNSKNLCYSESFKVGNVLGIENGSWEIENPKIGDWDLDGLIDNNSSFPFLDFQVDG

SEQ ID NO: 360 - protein, 343 aa, Arabidopsis thaliana
  misc_feature (1)..(343): Public GI ID no.15231922
  misc_feature (1)..(343): Bit score of 546.1 for HMM based on sequences of FIGURE 18.
  misc_feature (85)..(130): Pfam Name: Myb_DNA-binding Pfam Description: Myb-like DNA-binding domain
  misc_feature (1)..(343): Bit score of 546.1 for HMM based on sequences of FIGURE 18.
  misc_feature (1)..(343): Functional Homolog Of Ceres ANNOT ID no. 1461478 at SEQ ID NO. 342
MMMRKPDITTIRDKGKPNHACGGNNNKPKLRKGLWSPDEDEKLIRYMLTNGQGCWSDIARNAGLLRCGKSCRLRWINYLRPDLKRGSFSPQEEDLIFHLHSILGNRWSQIATRLPGRTDNEIKNFWNSTLKKRLKNNSNNNTSSGSSPNNSNSNSLDPRDQHVDMGGNSTSLMDDYHHDENMMTVGNTMRMDSSSPFNVGPMVNSVGLNQLYDPLMISVPDNGYHQMGNTVNVFSVNGLGDYGNTILDPISKRVSVEGDDWFIPPSENTNVIACSTSNNLNLQALDPCFNSKNLCHSESFKVGNVLGIENGSWEIENPKIGDWDLDGLIDNNSSFPFLDFQVD

SEQ ID NO: 361 - protein, 343 aa, Arabidopsis thaliana
  misc_feature (1)..(343): Public GI ID no.51970238
  misc_feature (1)..(343): Bit score of 546.1 for HMM based on sequences of FIGURE 18.
  misc_feature (85)..(130): Pfam Name: Myb_DNA-binding Pfam Description: Myb-like DNA-binding domain
  misc_feature (1)..(343): Bit score of 546.1 for HMM based on sequences of FIGURE 18.
  misc_feature (1)..(343): Functional Homolog Of Ceres ANNOT ID no. 1461478 at SEQ ID NO. 342
MMMRKPDITTIRDKGKPNHACGGNNNKPKLRKGLWSPDEDEKLIRYMLTNGQGCWSDIARNAGLLRCGKSCRLRWINYLRPDLKRGSFSPQEEDLIFHLHSILGNRWSQIATRLPGRTDNEIKNFWNSTLKKRLKNNSNNNTSSGSSPNNSNSNSLDPRDQHVDMGGNSTSLMDDYHHDENMMTVGNTMRMDSSSPFNVGPMVNSVGLNQLYDPLMISVPDNGYHQMGNTVNVFSVNGLGDYGNTVLDPISKRVSVEGDDWFIPPSENTNVIACSTSNNLNLQALDPCFNSKNLCHSESFKVGNVLGIENGSWEIENPKIGDWDLDGLIDNNSSFPFLDFQVD

SEQ ID NO: 362 - protein, 343 aa, Arabidopsis thaliana
  misc_feature (1)..(343): Public GI ID no.45357090
  misc_feature (1)..(343): Bit score of 543.1 for HMM based on sequences of FIGURE 18.
  misc_feature (85)..(130): Pfam Name: Myb_DNA-binding Pfam Description: Myb-like DNA-binding domain
  misc_feature (1)..(343): Bit score of 653.3 for HMM based on sequences of FIGURE 18.
  misc_feature (1)..(343): Functional Homolog Of Ceres ANNOT ID no. 1461478 at SEQ ID NO. 342
MMMRKPDITTIRDKGKPNHACGGNNNKPKLRKGLWSPDEDEKLIRYMLTNGQGCWSDIARNAGPLRCGKSCRLRWINYLRPDLKRGSFSPQEEDLIFHLHSILGNRWSQIATRLPGRTDNEIKNFWNSTLKKRLKNNSNNNTSSGSSPNNSNSNSLDPRDQHVDMGGNSTSLMDDYHHDENMMTVGNTMRMDSSSPFNVGPMVNSVGLNQLYDPLMISVPDNGYHQMGNTVNVFSVNGLGDYGNTILDPISKRVSVEGDDWFIPPSENTNVIACSTSNNLNLQALDPCFNSKNLCHSESFKVGNVLGIENGSWEIENPKIGDWDLDGLIDNNSSFPFLDFQVD

SEQ ID NO: 363 - protein, 343 aa, Malus x domestica
  misc_feature (1)..(343): Public GI ID no.71041096
  misc_feature (1)..(343): Bit score of 584.7 for HMM based on sequences of FIGURE 18.
  misc_feature (79)..(124): Pfam Name: Myb_DNA-binding Pfam Description: Myb-like DNA-binding domain
  misc_feature (1)..(343): Bit score of 584.7 for HMM based on sequences of FIGURE 18.
  misc_feature (1)..(343): Functional Homolog Of Ceres ANNOT ID no. 1461478 at SEQ ID NO. 342
MRKPEPSSAAAGKNNKENNSNSKLRKGLWSPEEDDKLMRYMINNGQGCWSDVARNAGLQRCGKSCRLRWINYLRPDLKRGAFLPQEEELIIHLHSLLGNRWSQIAARLPGRTDNEIKNFWNSTIKKRLKNLSSSNGSPNTSDSSPEAKDHRVVAASRFIIPGQEHGMVPIYMDSTSSFMQSAVLSHMFDPFPALDIDQGGLTLPGAGGYYNANPCITQREIGVGGGDDCYNFGGNGGFGSGDVDIGVEGEIFVPPLESVSIEDQNIKTETTYGDSKNNNIYYNNINSILTCNKTNKNIKGESIIGVGNYFDDDQEELTMGDWDLEDLMKDVSSSSFPFLDYQS

SEQ ID NO: 364 - protein, 319 aa, Medicago truncatula
  misc_feature (1)..(319): Public GI ID no.92891589
  misc_feature (1)..(319): Bit score of 484.5 for HMM based on sequences of FIGURE 18.
  misc_feature (75)..(120): Pfam Name: Myb_DNA-binding Pfam Description: Myb-like DNA-binding domain
  misc_feature (1)..(319): Bit score of 162.9 for HMM based on sequences of FIGURE 18.
  misc_feature (1)..(319): Functional Homolog Of Ceres ANNOT ID no. 1461478 at SEQ ID NO. 342
MRKPEICSTKNNININKKKLRKGLWSPEEDEKLMNYMVRNGQGCWSDVARNAGLERCGKSCRLRWINYLRPDLKRGAFSTQEEELIIHFHSLLGNRWSQIAARLPGRTDNEIKNFWNSTIKKRLKNLSSSTSPNPSDESSPEPNKDFNIQQGSYISIQHANYNSYMSMPMFTSSSTSPSPSILQNTIFNTMNIDTLPVMDHSGYFNNTVTTMPCFSSQNHEVEIKGSYLENGVFGSVNIGVEGDMENKCNIETNPNHSDYYFDDIKINNMLSNCNIIESNNNKIESRGEVVENLFQEQFNLGEWDFEELMKDVSSFLFS

SEQ ID NO: 365 - protein, 321 aa, Eucalyptus gunnii
  misc_feature (1)..(321): Public GI ID no.39725413
  misc_feature (1)..(321): Bit score of 572.6 for HMM based on sequences of FIGURE 18.
  misc_feature (75)..(120): Pfam Name: Myb_DNA-binding Pfam Description: Myb-like DNA-binding domain
  misc_feature (1)..(321): Bit score of 572.6 for HMM based on sequences of FIGURE 18.
  misc_feature (1)..(321): Functional Homolog Of Ceres ANNOT ID no. 1461478 at SEQ ID NO. 342
MGMAMGIKEKASSNPHNHKLRKGLWSPEEDEKLMRYMLTNGQGCWSDIARNAGLQRCGKSCRLRWINYLRPDLKRGAFSPQEEELIVHLHNILGNRWSQIAARLPGRTDNEIKNFWNSTLKKRLKMNSATSSSNESDLSNPQDIAAGIMPSFHAQYDVLATCMDSSPAPFPPMDNISAPNQFDPFPTLNNRCDTWEGVGFFTFPSGIAPVSMGDDSSYLNLEHAKVGLLGSEFSVPPLASSTTTTEENNYRSIGCGMDGKGENSFSNNNDSCFSNTTTASFKAEDDMSGFGNNLQAANLRIGEWDLEGLMDDLPSFPFLDF

SEQ ID NO: 366 - protein, 340 aa, Capsicum annuum
  misc_feature (1)..(340): Public GI ID no.33320067
  misc_feature (1)..(340): Bit score of 554.1 for HMM based on sequences of FIGURE 18.
  misc_feature (13)..(60): Pfam Name: Myb_DNA-binding Pfam Description: Myb-like DNA-binding domain
  misc_feature (1)..(340): Bit score of 331 for HMM based on sequences of FIGURE 18.
  misc_feature (1)..(340): Functional Homolog Of Ceres ANNOT ID no. 1461478 at SEQ ID NO. 342
MGHHCCSKQKVKRGLWSPEEDEKLIKHITTHGHSCWSSVPKLAGLQRCGKSCRLRWINYLRPDLKRGCFSEQEERIIIDVHRILGNKWAQIAKHLPGRTDNEVKNFWNSCIKKKLISQGFDPNTHNLLSRAAAAATPPHRNNKKKTNNNHTTSSVFTIETSLSPSSTKELVSMDMIKASLAALSPFPHTNSSTTVLTMPQFQTSWSHLYESACNYYNHVPIKTNIVYQNHSTSTGTFGIINENCMWGVTGFEPHHEFGPSNNIGHEEMQQGAQVQLQEENCLEEVYKVNDLHEFNKHGRIAENVTFDDSSDFDFEFVDSELIPCGIYTNVNSIDQLAWDC

SEQ ID NO: 367 - protein, 331 aa, Solanum lycopersicum
  misc_feature (1)..(331): Public GI ID no.1167486
  misc_feature (1)..(331): Bit score of 525.8 for HMM based on sequences of FIGURE 18.
  misc_feature (67)..(112): Pfam Name: Myb_DNA-binding Pfam Description: Myb-like DNA-binding domain
  misc_feature (1)..(331): Bit score of 525.8 for HMM based on sequences of FIGURE 18.
  misc_feature (1)..(331): Functional Homolog Of Ceres ANNOT ID no. 1461478 at SEQ ID NO. 342
MGHHSCCNQQKVKRGLWSPEEDEKLIRYITSHGYGCWSEVPEKAGLQRCGKSCRLRWINYLRPDIRRGRFTPEEEKLIISLHGAVGNRWAHIASHLPGRTDNEIKNYWNSWIKKKLKKTSKSSTNTTSITDHHHHQHQNQRPQLTNYNTITSQQDIFFTQDIGTKSQVLLQDSTLFNSPNQLFFFDGGSLDSMTNVLINDATNRNATNNTSLFQETSILNSEFCWQVDQQQVQTSSYAIGMNSNYLPPLIESMVPPMEIPSSNNNNNIILEGQENNNELNEWNSQVDTQQCCPSYLFWDQENGSIGGDHEIIDPTTSNNMGQILSSFPSTL

SEQ ID NO: 368 - protein, 333 aa, Craterostigma plantagineum
  misc_feature (1)..(333): Public GI ID no.1002798
  misc_feature (1)..(333): Bit score of 555.8 for HMM based on sequences of FIGURE 18.
  misc_feature (82)..(127): Pfam Name: Myb_DNA-binding Pfam Description: Myb-like DNA-binding domain
  misc_feature (1)..(333): Bit score of 347.2 for HMM based on sequences of FIGURE 18.
  misc_feature (1)..(333): Functional Homolog Of Ceres ANNOT ID no. 1461478 at SEQ ID NO. 342
MNQQQVKVSKNNKQVNNCEDDDDSSDLRRGPWTVDEDFTLINYIAHHGEGRWNSLARFAGLKRTGKSCRLRWLNYLRPDVRRGNITLEEQLLILELHSRWGNRWSKIAQHLPGRTDNEIKNYWRTRVQKHAKQLKCDVNSKQFKDTMRYLWMPRLVERIQASATTDDGAPPAVVSSPSSAMNTACYTTAMAAGDHRRQFMLMPQYYATTTTTHNNSMIAQENSSTVASSESFGSLSSELTAEANYANYHRVINGADHQQIDSSTTSYGWQNCAVGNNGNSDQLGMGFADDRRSNEQWMMMTDDVVDNGGSSDQDNNLWNVDDVWFLQQFSSCF

SEQ ID NO: 369 - protein, 302 aa, Hordeum vulgare
  misc_feature (1)..(302): Public GI ID no.547958
  misc_feature (1)..(302): Bit score of 544.5 for HMM based on sequences of FIGURE 18.
  misc_feature (16)..(63): Pfam Name: Myb_DNA-binding Pfam Description: Myb-like DNA-binding domain
  misc_feature (1)..(302): Bit score of 544.5 for HMM based on sequences of FIGURE 18.
  misc_feature (1)..(302): Functional Homolog Of Ceres ANNOT ID no. 1461478 at SEQ ID NO. 342
MGRPSSGAVGQPKVRKGLWSPEEDEKLYNHIIRHGVGCWSSVPRLAALNRCGKSCRLRWINYLRPDLKRGCFSQQEEDHIVALHQILGNRWSQIASHLPGRTDNEIKNFWNSCIKKKLRQQGIDPATHKPMASADTATAAAALPDAEEEDRKPLCPAVDGSLVPKQPAVFDPFPLCVDYGAGFAEELGAANAAALYGQLCGGKEVADDDAGFGAADYSCVLDVSENLGYGESSSNSSNWNYGGEVGSVLDGEVPHWAKAEPAFAEMERQQQHSPAEQKLSLPCQEQSLLASFDFNLELEPYF

SEQ ID NO: 370 - DNA, 1454 bp, Triticum aestivum
  misc_feature (1)..(1454): Ceres CLONE ID no.851672
  misc_feature (1)..(1454): Encodes the peptide sequence at SEQ ID NO 371
atcgctccgtcggtcgtttcttcctctgccattgccgccatcgtcggccgccgcctactgctcgccacggccggctagcagagctgcacgggcggcaacgccactgagctttggttcacgtcgtctcagtccgtctcagtccgtcggcggcatgtcgaagcggccgggtgggacgaagaagaggctgaagcgcggcctctggtcgccggaggaggacgagaagctcatgaaccacattgccaagtacggcaacggctgctggagctccatccccaagattgcaggccttgagaggtgcgggaagagctgcaggctgaggtggataaactacctgaggccggacctcaagaggggcgccttctcgcaggaggaggaggacctcatcatccacctccactccatcctcggcaacaagtggtctcagatcgccgcgcagctgccggggcgcaccgacaacgaagtcaagaacttctggaactccttcatcaagaagaagctccgccagcgcggcatcgacccggccacccacaagccgctcgcccccgccagcgctccccccgccgccacgcctgtcagccgcagcgccgtgttcagcgaggccgagctgatactgtcgtcgcccgtggggggacagcacatgccgccgctggtgtcggcggagagctacgtgtacagccggggcagcatggacggcgccggcggcgtggtgggcgggtgcagtgacgacgggtccctgtcgtcgctttcggggtacaacaacaacaaccagacggcggacgcgctgcacggcggggttatcccgtcggtgtcgagctccagcacgctgaactcgatggccggggtgagccccggcggcgcggccaacaccaacgccaccacggacgagctgtgctgcaacaacaacccgagcaacagcggcagcgggttcgagtcgtccacgacgcagagcagcagcaaccaccacctgccgtggctggagctggggtcgatcagcagctgcaccgaggacgccagcggcgccggcgccggcgccgaccactacggtgcggcgctggatgagctcaagtggtccgactacgtgttcgacggcggctaccagcagtaccaccagcagggccagtgcatctacggcgacagcaaggccgccgccgacgcagcggcggcgcagttcgacgcgcacgggctgggcatcaactggtgcttgaattgaactcatccaaccgacagtccgacaccaaaggccggcggccagcaatcagccgctgctgccgccactacatgcaaagatccagattgtaacgtatacgcgagtttataatactcctagctactaagaaatgtttggtgaggttttggcttgtaaattgtttctcccttacgttctctcttgtttctttctttctttcatcttgagttggtgattgattgattgatctgcaaaaaaaaaaaaaaaa

SEQ ID NO: 371 - protein, 352 aa, Triticum aestivum
  misc_feature (1)..(352): Ceres CLONE ID no.851672
  misc_feature (1)..(352): Bit score of 569.1 for HMM based on sequences of FIGURE 18.
  misc_feature (14)..(61): Pfam Name: Myb_DNA-binding Pfam Description: Myb-like DNA-binding domain
  misc_feature (1)..(352): Bit score of 569.1 for HMM based on sequences of FIGURE 18.
  misc_feature (1)..(352): Functional Homolog Of Ceres ANNOT ID no. 1461478 at SEQ ID NO. 342
MSKRPGGTKKRLKRGLWSPEEDEKLMNHIAKYGNGCWSSIPKIAGLERCGKSCRLRWINYLRPDLKRGAFSQEEEDLIIHLHSILGNKWSQIAAQLPGRTDNEVKNFWNSFIKKKLRQRGIDPATHKPLAPASAPPAATPVSRSAVFSEAELILSSPVGGQHMPPLVSAESYVYSRGSMDGAGGVVGGCSDDGSLSSLSGYNNNNQTADALHGGVIPSVSSSSTLNSMAGVSPGGAANTNATTDELCCNNNPSNSGSGFESSTTQSSSNHHLPWLELGSISSCTEDASGAGAGADHYGAALDELKWSDYVFDGGYQQYHQQGQCIYGDSKAAADAAAAQFDAHGLGINWCLN

SEQ ID NO: 372 - DNA, 1282 bp, Zea mays
  misc_feature (1)..(1282): Ceres CLONE ID no.1711992
  misc_feature (1)..(1282): Encodes the peptide sequence at SEQ ID NO 373
gcttctggcacttgaatccgtttgcgtcgtcgtcgttcctgtgtgcagtgcgcggtgcgccactgctagtgagaagagatatagctaggcttcagtgcgacgacgacgacgagatggggcaccactcctgctgcaacaagcagaaggtccggaggggcttgtggtcgccggaggaggacgagaagctcgtcaagtacatcaccgcgcacggccatggttgctggagctcagtcccaaggcaagcagggctgcagcggtgcggcaagagctgcaggctgaggtggatcaactacctgaggccggacctgaagaggggaagcttctcgcagcaggaggaggccctcatcgtcgagctccacagggtgcttgggaacaggtgggcccagatcgccaagcatctgcctggtagaacggacaacgaggtgaagaacttctggaactccaccatcaagaagaagctcatctcccaggccgtgggcagcctccacccagacctgtactacaacattctggatggaggagccgccggagcacaggacctcgcggccgccggatgcgcgccgctgaacggggcggacagcgcgtcagcagcggcggcgcaagcagtgggcgtgacgacgacgcagccttctccttccatggcgcacgtcgaccccgcggcggcgtgggcggcggacttcggctcccagacgctcttcctccccggcggcgcggccgctctccagtacgccgccgccgtcgagggggagttcgtcaagcagtgccgcacggcggcggacgcctgctacccgccggagccggaggacggcggcggcggcgcgaggcagtgcaacaaccaggcagctgccgatgtcgtgacggcggcggtgcaaccggaaggcgccggcctcccggtgttccttgaacccaagtgcgccggcagtttcatgcccgagcctgctctggctccggtgatggacttcatggaagccatcctggggtcgacggcggcggcgtcggctgccagcgcttcgtctctcgacgacacctgcttctcggcgaacgccggcatgcagtcccactgttggattccctgaattattcaccctatttacttccatcggtagatgcatatatacatgcatggatgactcttcatcaagcgcgcgcggagtatcagatatgattaagtatagagtttatgaaataattaatatagatatagtaggtttctctcactctcatcgatcagggtagtaacaacatgggttacatgtaaatatgtttacgtacgtatatataa

SEQ ID NO: 373 - protein, 320 aa, Zea mays
  misc_feature (1)..(320): Ceres CLONE ID no.1711992
  misc_feature (1)..(320): Bit score of 516.1 for HMM based on sequences of FIGURE 18.
  misc_feature (67)..(112): Pfam Name: Myb_DNA-binding Pfam Description: Myb-like DNA-binding domain
  misc_feature (1)..(320): Bit score of 516.1 for HMM based on sequences of FIGURE 18.
  misc_feature (1)..(320): Functional Homolog Of Ceres ANNOT ID no. 1461478 at SEQ ID NO. 342
MGHHSCCNKQKVRRGLWSPEEDEKLVKYITAHGHGCWSSVPRQAGLQRCGKSCRLRWINYLRPDLKRGSFSQQEEALIVELHRVLGNRWAQIAKHLPGRTDNEVKNFWNSTIKKKLISQAVGSLHPDLYYNILDGGAAGAQDLAAAGCAPLNGADSASAAAAQAVGVTTTQPSPSMAHVDPAAAWAADFGSQTLFLPGGAAALQYAAAVEGEFVKQCRTAADACYPPEPEDGGGGARQCNNQAAADVVTAAVQPEGAGLPVFLEPKCAGSFMPEPALAPVMDFMEAILGSTAAASAASASSLDDTCFSANAGMQSHCWIP

SEQ ID NO: 374 - protein, 336 aa, Lotus japonicus
  misc_feature (1)..(336): Public GI ID no.30024600
  misc_feature (1)..(336): Bit score of 607.7 for HMM based on sequences of FIGURE 18.
  misc_feature (14)..(61): Pfam Name: Myb_DNA-binding Pfam Description: Myb-like DNA-binding domain
  misc_feature (1)..(336): Bit score of 607.7 for HMM based on sequences of FIGURE 18.
  misc_feature (1)..(336): Functional Homolog Of Ceres ANNOT ID no. 1461478 at SEQ ID NO. 342
MGRSPCCDENGLKKGPWTPEEDQKLVEHIQKHGHGSWRALPKLAGLNRCGKSCRLRWTNYLRPDIKRGKFSPEEEQTILHLHSILGNKWSTIATHLPGRTDNEIKNFWNTHLKKKLIQMGFDPMTHQPRTDLVSTLPYLLALANMTQLMDHNHQSFDEQAVQLAKLQYLNYLLQSSNNPLCMTNSYDQNALTNMEAFSLLNSISNVKENLGVDFSQMDTQTSLFSHDGNNMASSQPLHHPSNMLPHFLDPQVSFSSQSCLNNNEQGQGTNNFAISQRDHTGDESSWINIPSINPPNAIGTSGDASSSTSSYGGAGPSPYNWSELFFEDPTTMHELS

SEQ ID NO: 375 - protein, 330 aa, Zea mays subsp. parviglumis
  misc_feature (1)..(330): Public GI ID no.11526775
  misc_feature (1)..(330): Bit score of 476.0 for HMM based on sequences of FIGURE 18.
  misc_feature (113)..(330): Pfam Name: P_C Pfam Description: P protein C-terminus
  misc_feature (113)..(330): Pfam Name: P_C Pfam Description: P protein C-terminus
  misc_feature (67)..(112): Pfam Name: Myb_DNA-binding Pfam Description: Myb-like DNA-binding domain
  misc_feature (1)..(330): Bit score of 476 for HMM based on sequences of FIGURE 18.
  misc_feature (1)..(330): Functional Homolog Of Ceres ANNOT ID no. 1461478 at SEQ ID NO. 342
MGRAPCCEKVGLKRGRWTAEEDQLLANYIAEHGEGSWRSLPKNAGLLRCGKSCRLRWINYLRADVKRGNISKEEEDIIIKLHATLGNRWSLIASHLPGRTDNEIKNYWNSHLSRQIHTYRRKYTAGPEDTAIAIDMSKLQSTDRRRGGRTPGRPPKTSASRTKQPDADQPGGEAKGAAASSPRHSDAVNPGPNQPNSSSGSTGTAEEEGPSSEDASGPWVLEPIELGDLVWGEADSEMDALMPIGPGGHDSAALEGLGAVGCEAQVDDLFDMDWDGFAAHLWGGPEQDDHSAQLRQAAEPLEASAAATAACTPDDRELEAFENWLLSDSF

SEQ ID NO: 376 - protein, 375 aa, Populus x canescens
  misc_feature (1)..(375): Public GI ID no.22795039
  misc_feature (1)..(375): Bit score of 489.4 for HMM based on sequences of FIGURE 18.
  misc_feature (67)..(112): Pfam Name: Myb_DNA-binding Pfam Description: Myb-like DNA-binding domain
  misc_feature (1)..(375): Bit score of 392.7 for HMM based on sequences of FIGURE 18.
  misc_feature (1)..(375): Functional Homolog Of Ceres ANNOT ID no. 1461478 at SEQ ID NO. 342
MGRAPCCEKNGLKRGPWTPDEDQKLIGYIQKHGYGNWRTLPKNAELQRCGKSCRLRWTNYLRPDIKRGRFSFEEEETIIQLHGILGNKWSAIAARLPGRTDNEIKNYWNTHIRKRLLRMGIDPVTHSPRLDLLDLSSILNSPLYDSSRMNMSRILGVQPLGDPELLRLATSLLSSQRDQTQDFAIPNGHQENHLSSPQVHQNQNQSIIHQANQFQPAGQEMPACTALTTTPCVTFSNEAQQMDPNGDQYHLSTITTFSSPNSQVSTHDQWQSNRMGSNLSEDYYVPAVSSYNSADNCRGTDLVDPSSEASTFISNNSNQTFGFASVLSTPSSSPAPLNSNSTYINCSSTEDERDSYCSNFLKFEIPDILDVSNFM

SEQ ID NO: 377 - protein, 340 aa, Boea crassifolia
  misc_feature (1)..(340): Public GI ID no.30575840
  misc_feature (1)..(340): Bit score of 490.9 for HMM based on sequences of FIGURE 18.
  misc_feature (69)..(114): Pfam Name: Myb_DNA-binding Pfam Description: Myb-like DNA-binding domain
  misc_feature (1)..(340): Bit score of 490.9 for HMM based on sequences of FIGURE 18.
  misc_feature (1)..(340): Functional Homolog Of Ceres ANNOT ID no. 1461478 at SEQ ID NO. 342
MGRAPCCDKTGLLMKKGPWSQEEDQKLLDYIQKYGYGNWRTLPTNAGLQRCGKSCRLRWTNYLRPDIKRGRFSFEEEETIIRLHSILGNKWSLIAARLPGRTDNEIKNYWNTNIRKRLLRMGIDPVTHSPRLQLLDLSTILNSSLCNNSPTQMNFSRLQPRFNPELLRFAASLFSSNCQSQDFPMQNQITSNNQIPPPFMQTSVQDVAVLPDLCADTNLGTSFSVHDEVQEFQQNPAGYGMPSALTGEYVPVLNDGYYGSGDQPFVDPTPSSVTSNFQSYCSNSLGFQSIFSTPPSSPTPLNSNSTYVNSCSSTEDETESYYNSMWKFEIPDNLRINDFM

SEQ ID NO: 378 - protein, 364 aa, Picea abies
  misc_feature (1)..(364): Public GI ID no.56605372
  misc_feature (1)..(364): Bit score of 898.9 for HMM based on sequences of FIGURE 19.
  misc_feature (34)..(85): Pfam Name: Dimerisation Pfam Description: Dimerisation domain
  misc_feature (95)..(340): Pfam Name: Methyltransf_2 Pfam Description: O-methyltransferase
  misc_feature (95)..(340): Pfam Name: Methyltransf_2 Pfam Description: O-methyltransferase
  misc_feature (1)..(364): Bit score of 396.8 for HMM based on sequences of FIGURE 19.
  misc_feature (1)..(364): Functional Homolog Of Ceres ANNOT ID no. 1520476 at SEQ ID NO. 342
MGSASENSEMNTKIVNEDEWLLGMELGNFSCLPMGMKAAIELDVLQIIANAGNGVQLSPRQIVAHIPTTNPDAAITLDRILRVLASHSVLSCSVTTDENGKAERLYGLTPLCKYLVKNQDGVSLAPLVLMNQDKVLMDSWYYLKDAVLEGSQPFTKAHGMNAFEYPAKDQRFNRVFNRGMSEHSTMLMNKILDTYQGFKEVQELVDVGGGVGSTLNLIVSRYPHISGINFDMPHVVTDAPHYPAVKHVGGDMFDSVPTGQAIFMKWILHDWSDDHCRKLLKNCHKALPEKGKVIVVDTILPVAAETSPYARQGFHIDLLMLAYNPGGKERTEQEFQDLAKEAGFAGGVKPVCCANGMWVMEFHK

SEQ ID NO: 379 - protein, 382 aa, Pinus radiata
  misc_feature (1)..(382): Public GI ID no.4574324
  misc_feature (1)..(382): Bit score of 655.0 for HMM based on sequences of FIGURE 19.
  misc_feature (104)..(358): Pfam Name: Methyltransf_2 Pfam Description: O-methyltransferase
  misc_feature (104)..(358): Pfam Name: Methyltransf_2 Pfam Description: O-methyltransferase
  misc_feature (46)..(96): Pfam Name: Dimerisation Pfam Description: Dimerisation domain
  misc_feature (1)..(382): Bit score of 655 for HMM based on sequences of FIGURE 19.
  misc_feature (1)..(382): Functional Homolog Of Ceres ANNOT ID no. 1520476 at SEQ ID NO. 342
MDSNMNGLAKSNGCEISRDGFFESEEEELQGQAEAWKCTFAFAESLAVKCVVLLGIPDMIAREGPRATLSLGEIVAKLPTESPDAACLFRIMRFLVAKGIFRASKSAREGGAFETRYGLTPASKWLVKGRELSMAPMLLMQNDETTLAPWHHFNECVLEGGVAFQKANGAEIWSYASDHPDFNNLFNNAMACNARIVMKAILSKYQGFHSLNSLVDVGGGTGTAVAEIVRAYPFIRGINYDLPHVVATASSLSGVQHVGGDMFETVPTGDAIFMKWIMHDWNDEDCIKILKNCRKAIPDTGKVIIVDVVLDADQGDNTDKKRKKAVDPIVGTVFDLVMVAHSSGGKERSEKEWKRILLEGGFSRYNIIEIPALQSVIEAFPR

SEQ ID NO: 380 - protein, 382 aa, Pinus radiata
  misc_feature (1)..(382): Public GI ID no.1568664
  misc_feature (1)..(382): Bit score of 645.9 for HMM based on sequences of FIGURE 19.
  misc_feature (104)..(358): Pfam Name: Methyltransf_2 Pfam Description: O-methyltransferase
  misc_feature (104)..(358): Pfam Name: Methyltransf_2 Pfam Description: O-methyltransferase
  misc_feature (46)..(96): Pfam Name: Dimerisation Pfam Description: Dimerisation domain
  misc_feature (1)..(382): Bit score of 396.8 for HMM based on sequences of FIGURE 19.
  misc_feature (1)..(382): Functional Homolog Of Ceres ANNOT ID no. 1520476 at SEQ ID NO. 342
MDSNMNGLAKSNGCEISRDGFFESEEEELQGQAEAWKCTFAFAESLAVKCVVLLGIPDMIAREGSRATLSLGEIVAKLPTESPDAACLFRIMRFLVAKGIFRASKSAREGGAFETRYGLTPASKWLVKGRELSMAPMLLMQNDETTLAPWHHFNECVLEGGVAFQKANGAEIWSYASDHPDFNNLFNNAMACNARIVMKGILSKYQGFHSLNSLVDVGGGTGTAVAEIVRAYPFITGINYDLPHVVATASSLSGVQHVGGDMFETVPTGDAIFMKWIMHDWNDEDCIKILKNCRKAIPDTGKVIIVDVVLDADQGDNTDKKRKKAVDPIVGTVFDLVMVAHSSGGKERSEKEWKRILLEGGFSRYNIIEIPALQSVIEAFPR

SEQ ID NO: 381 - protein, 381 aa, Coptis japonica
  misc_feature (1)..(381): Public GI ID no.24212392
  misc_feature (1)..(381): Bit score of 530.6 for HMM based on sequences of FIGURE 19.
  misc_feature (114)..(355): Pfam Name: Methyltransf_2 Pfam Description: O-methyltransferase
  misc_feature (53)..(104): Pfam Name: Dimerisation Pfam Description: Dimerisation domain
  misc_feature (1)..(381): Bit score of 530.6 for HMM based on sequences of FIGURE 19.
  misc_feature (1)..(381): Functional Homolog Of Ceres ANNOT ID no. 1520476 at SEQ ID NO. 342
MCTSLSELKCPVFSTKRKLLLEFALRTSVDMAAQEGVNYLSGLGLSRLICLPMALRAAIELNVFEIISQAGPDAQLSPSDIVAKIPTKNPSAAISLDRILRMLGASSILSVSTTKSGRVYGLNEESRCLVASEDKVSVVPMLLFTSDKAVVESFYNIKDVVLEEGVIPFDRTHGMDFFQYAGKEERVNKSFNQAMGAGSTIAFDEVFKVYKGFDNLKELVDVGGGIGTSLSNIVAKHPHIRGINFELPHVIGDAPDYPGVEHVPGDMFEGVPNAQNILLKWVLHDWDDDRSIKILKNCWKALPENGTVIVIEFVLPQVLGNNAESFNALTPDLLMMALNPGGKERTTIEFDGLAKAAGFAETKFFPISQGLHVMEFHKINC

SEQ ID NO: 382 - protein, 360 aa, Papaver somniferum
  misc_feature (1)..(360): Public GI ID no.33286376
  misc_feature (1)..(360): Bit score of 948.5 for HMM based on sequences of FIGURE 19.
  misc_feature (28)..(80): Pfam Name: Dimerisation Pfam Description: Dimerisation domain
  misc_feature (89)..(336): Pfam Name: Methyltransf_2 Pfam Description: O-methyltransferase
  misc_feature (89)..(336): Pfam Name: Methyltransf_2 Pfam Description: O-methyltransferase
  misc_feature (1)..(360): Bit score of 948.5 for HMM based on sequences of FIGURE 19.
  misc_feature (1)..(360): Functional Homolog Of Ceres ANNOT ID no. 1520476 at SEQ ID NO. 342
MGSIRNVDEDIQACRYAMELASASVPVMVLKTAIELDILEIIKKPGPGTQISVSEIVSQIQNLKNPDAPVMLDRMLRLLASYNILTCSLKDGGNDDKVERLYGLAPVCKFLTKNEAGCSMSALLLMNQDKVLMESWYHLKDAILDGGIPFNKAYGVHAFEYHGKDLRFNKVFNKGMSDHTTITMNKILETYKGFEGLNSIVDVGGGVGATVSMIISKYPTIQGINFDLPHVIQDAPSFPGIKHVGGDMFASVPNADAIFMKWILHDWSDEHSVKILKNCYDALPKNGKVIIVECIIPEVSDSSVAGHGVFHLDNIMLAHNPGGKERSLKQFENLAKDTGFTDFQVVCSAYDTYVMEFYKN

SEQ ID NO: 383 - protein, 358 aa, Gossypium hirsutum
  misc_feature (1)..(358): Public GI ID no.133902324
  misc_feature (1)..(358): Bit score of 883.3 for HMM based on sequences of FIGURE 19.
  misc_feature (25)..(76): Pfam Name: Dimerisation Pfam Description: Dimerisation domain
  misc_feature (86)..(331): Pfam Name: Methyltransf_2 Pfam Description: O-methyltransferase
  misc_feature (86)..(331): Pfam Name: Methyltransf_2 Pfam Description: O-methyltransferase
  misc_feature (1)..(358): Bit score of 883.3 for HMM based on sequences of FIGURE 19.
  misc_feature (1)..(358): Functional Homolog Of Ceres ANNOT ID no. 1520476 at SEQ ID NO. 342
MSQEDQEEEVGKLAVRLANAVVLPMVLKSALELNIIDTISAAGDGAFLSPSQIASALPSKNPGAPVLLDRMLRLLASHSILKCSVKAKEKGEIERLYGAGPLCKFLVKNQDGGSIAPLLLLHHDQVFMQSWYHLNDAILEGGVPFSKAYGMTAFEYPGTDQRFNRVFNQAMSNHTALIMRKIVDVYKGFDGLKVLVDVGGGIGVALSFITSKYPQIKGINFDLPHVLADAPTYSGVEHVGGDMFESVPKGDAIFLKWILHDWSDEHCLKLVKNCWEALPNGGKVIIVESILPEVPDTSVSSNIVCEQDLFMLAQNPGGKERTLKEYEALALKTGFSSCEVICCAYNSWVMQMEKRAIY

SEQ ID NO: 384 - protein, 358 aa, Gossypium hirsutum
  misc_feature (1)..(358): Public GI ID no.133902316
  misc_feature (1)..(358): Bit score of 886.0 for HMM based on sequences of FIGURE 19.
  misc_feature (25)..(76): Pfam Name: Dimerisation Pfam Description: Dimerisation domain
  misc_feature (87)..(331): Pfam Name: Methyltransf_2 Pfam Description: O-methyltransferase
  misc_feature (87)..(331): Pfam Name: Methyltransf_2 Pfam Description: O-methyltransferase
  misc_feature (1)..(358): Bit score of 886 for HMM based on sequences of FIGURE 19.
  misc_feature (1)..(358): Functional Homolog Of Ceres ANNOT ID no. 1520476 at SEQ ID NO. 342
MSQEDQEEEVGKLAVRLANAVVLPMVLKSALELNIIDTILAAGDGAFLSPSQIASALPSKNPDAPVLLDRMLRLLASHSILKCAVKAKEKEEIERLYGAGPLCKFLVKNQDGGSIAPLLLLHHDQVFMQSWYHLNDAILEGGVPFSKAYGMTAFEYPGTDQRFNRVFNQAMSNHTALIMRKIVDVYKGFDGLKVLVDVGGGIGVALSFITSKYPQIKGINFDLPHVLADAPTYSGVEHVGGDMFESVPKGDAIFLKWILHDWSDEHCLKLLKNCWEALPNGGKVIIVESILPEVPDTSVSSNIVCEQDLFMLAQNPGGKERTLKEYEDLALKTGFSGCEVICCAYNSWVMQMEKRAIY

SEQ ID NO: 385 - protein, 345 aa, Gossypium hirsutum
  misc_feature (1)..(345): Public GI ID no.133902317
  misc_feature (1)..(345): Bit score of 774.2 for HMM based on sequences of FIGURE 19.
  misc_feature (25)..(76): Pfam Name: Dimerisation Pfam Description: Dimerisation domain
  misc_feature (87)..(318): Pfam Name: Methyltransf_2 Pfam Description: O-methyltransferase
  misc_feature (1)..(345): Bit score of 774.2 for HMM based on sequences of FIGURE 19.
  misc_feature (1)..(345): Functional Homolog Of Ceres ANNOT ID no. 1520476 at SEQ ID NO. 342
MSQEDQEEEVGKLAVRLANAVILPMVLKSALELNIIDTILAAGDGAFLSPSQIASALPSKNPDAPVLLDRMLRLLASHSILKCSVKAKEKEEIERLYGAGPLCKFLVKNQDGGSIAPLLVLHHDQVFMQSWYHLNDAILEGGFPFSKAYGMTAFEYPGTDQRFNRVFNQAMSNHTALIMREIVDVYKGFDGLKVLVDVGGGIGVALSFITSKYPQIKGINFDLPHVLADAPTYSGVEHVGGDMFESVPKGDAIFLKLSLNCWEAVPNGGKVIIVESILPEVPDTSVSSNIVCEQDLFMLAQIPGGKERTLKEYEALALKTGFSGCEVICCAYNSWVMQMEKRAIY

SEQ ID NO: 386 - DNA, 1463 bp, Gossypium hirsutum
  misc_feature (1)..(1463): Ceres CLONE ID no.1930109
  misc_feature (1)..(1463): Encodes the peptide sequence at SEQ ID NO 387
aaagtgaaacaaccagaaacaggcgctgagaaagaaaccatgtctcaagaagatcaagaggaagaagttgggaaactggccgttcgcctagccaacgccgtgatacttccaatggtcttgaaatcagccttggagctgaacataattgacacaattttagccgctggtgacggcgcgtttctgtcaccttcccagattgcgagtgcccttccttccaagaatcctgacgcaccagtgctactagatcgaatgctacgcctgttggccagccattccattctcaaatgctcagtaaaagcaaaggaaaaagaagaaattgaaagactgtacggtgcaggcccactatgcaagttccttgttaagaatcaagatggagggtcgattgcacctctccttgtgttgcaccatgaccaagtcttcatgcaaagctggtaccatttaaatgatgctatactagaaggagggtttccttttagtaaggcatacgggatgacagcatttgaatatccaggaactgatcaacgattcaatagagtatttaaccaggcaatgtcaaatcatactgctttgataatgagggagattgttgatgtttacaaagggtttgatgggttgaaagtgttggttgatgtgggtggtgggattggggttgctctcagttttattacttcaaagtatcctcaaatcaagggcatcaactttgatctgcctcatgttttggctgatgcacccacttattcaggtgttgagcatgttggcggggatatgtttgaaagtgttccaaaaggtgatgctattttcttaaagtggatactccgtggttggagtgatgaacattgcttgaagcttctcaataactgttgggaagctgtccctgaactgttgggaagctgtccctaatggtgggaaagtgattattgtggaatccatcttacccgaggttcccgataccagtgtttcttctaacattgtctgtgaacaagatctgtttatgttagctcaaatcccggggggcaaagagagaaccctaaaggaatatgaggccttagctttaaaaacaggtttctctggctgtgaagtaatctgctgtgcttataacagctgggtcatgcaaatggagaaaagggcaatttattgaagttctattggaaacttctatttcctttcatctacccccacaggaggattcaacataatgtttacttttcataatgtttgataatattcttggggtttattcaaatttacgttccgttgataatacttttaagttctgctagtgatgatgatgatgatgatgaaaagaaacttctaaaatgatcccgagacatgcatatttatttgtattatgaaatttctacaaagaaaaaaaaaacgaactgtacttattatgttaaataataacaaaattaatgctcaaggtttgatttggttattacttttaaaaaaaaaaaaaaaaaaaa

SEQ ID NO: 387 - protein, 286 aa, Gossypium hirsutum
  misc_feature (1)..(286): Ceres CLONE ID no.1930109
  misc_feature (1)..(286): Bit score of 577.1 for HMM based on sequences of FIGURE 19.
  misc_feature (25)..(76): Pfam Name: Dimerisation Pfam Description: Dimerisation domain
  misc_feature (87)..(279): Pfam Name: Methyltransf_2 Pfam Description: O-methyltransferase
  misc_feature (1)..(286): Bit score of 577.1 for HMM based on sequences of FIGURE 19.
  misc_feature (1)..(286): Functional Homolog Of Ceres ANNOT ID no. 1520476 at SEQ ID NO. 342
MSQEDQEEEVGKLAVRLANAVILPMVLKSALELNIIDTILAAGDGAFLSPSQIASALPSKNPDAPVLLDRMLRLLASHSILKCSVKAKEKEEIERLYGAGPLCKFLVKNQDGGSIAPLLVLHHDQVFMQSWYHLNDAILEGGFPFSKAYGMTAFEYPGTDQRFNRVFNQAMSNHTALIMREIVDVYKGFDGLKVLVDVGGGIGVALSFITSKYPQIKGINFDLPHVLADAPTYSGVEHVGGDMFESVPKGDAIFLKWILRGWSDEHCLKLLNNCWEAVPELLGSCP

SEQ ID NO: 388 - protein, 365 aa, Populus tremuloides
  misc_feature (1)..(365): Public GI ID no.231757
  misc_feature (1)..(365): Bit score of 1065.6 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1065.6 for HMM based on sequences of FIGURE 19.
  misc_feature (1)..(365): Functional Homolog Of Ceres ANNOT ID no. 1520476 at SEQ ID NO. 342
MGSTGETQMTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILDGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHVDVIMLAHNPGGKERTEKEFEGLAKGAGFQGFEVMCCAFNTHVIEFRKKA

SEQ ID NO: 389 - DNA, 1308 bp, Populus balsamifera subsp. trichocarpa
  misc_feature (1)..(1308): Ceres ANNOT ID no.1475680
  misc_feature (1)..(1308): Encodes the peptide sequence at SEQ ID NO 390
atggcaacctcaacctatgaggaagactatcatctccagtatgctatgcaactttcaagagcatcagtgctgcctctggttttgaaagcagcaatagagctaggtgtgtttgagataatagaaaaggctggtcctgatgccttgctctcagcttcagatattgtcgctcaatttcccacacaaaacaacccggaagcccatattctgctagacctgtccaccaagaatattcaggatggtcattcccagaggttatatggattagcacctgtggccaaatactttaccaagaaccaggatggaggatcgttgagtccctttttagctatgattcatgacaatgtcatgatggatatgtggtaccacttaaaagacgcagttctggaaggagggattccatttgaaaaggctcacgggataaattctgcagaatatctaaaaaaagatgcaagattttgtgagctattcagcagttccatgaaaagtttcaacgttacatttatggagacaattctggacatatatgatggatttgaaggtgtaaaatgcttggtggatgtgggtggtggcaatggttctatccttaacatgatcattaccaagtaccctgcaattaagggtatcaactatgatttggcttcagttgtggaaagctcaccatcctacccaggaattgagcatgtcgcgggggacggattcgtaacaattccgaaaggaggagatgccattttcatgaagtggataactcacaactgggacgatgagcacttgctaaaactgctaaagaattgttatgaagctttaccagacaacggaaaagttatagtagtggatatggtagttccagaaacccctgaaaccaatgttaaagctaaaagcatgctacagaattatttgttcatgtcaagcatgagtccacaaggaaaagaaaggacagaaaaagaatttgaaaccttgggaaaggaagctggattttctcatattcgagttgcttgttttctccggaaactggacttggctgcacagcaagttctggtgcagaaatggaggcctaaaccactacaagttttttctgtagatgattctatacctgatcagcaagtgccctggccgaaacactttttcgaaacagtatctgcacgagagatttcaaccccatatttatggagagaattctggatgcatggtggcttcgaaggtgtaaaaaccttggtggatgtgggtagtgacgatggttctgtgcttaacatgatcatttctaattatcctgccgttaagggtatcgactatgatttggctcagttgtaa

SEQ ID NO: 390 - protein, 435 aa, Populus balsamifera subsp. trichocarpa
  misc_feature (1)..(435): Ceres ANNOT ID no.1475680
  misc_feature (1)..(435): Bit score of 730.8 for HMM based on sequences of FIGURE 19.
  misc_feature (26)..(71): Pfam Name: Dimerisation Pfam Description: Dimerisation domain
  misc_feature (74)..(321): Pfam Name: Methyltransf_2 Pfam Description: O-methyltransferase
  misc_feature (1)..(435): Bit score of 730.8 for HMM based on sequences of FIGURE 19.
  misc_feature (1)..(435): Functional Homolog Of Ceres ANNOT ID no. 1520476 at SEQ ID NO. 342
MATSTYEEDYHLQYAMQLSRASVLPLVLKAAIELGVFEIIEKAGPDALLSASDIVAQFPTQNNPEAHILLDLSTKNIQDGHSQRLYGLAPVAKYFTKNQDGGSLSPFLAMIHDNVMMDMWYHLKDAVLEGGIPFEKAHGINSAEYLKKDARFCELFSSSMKSFNVTFMETILDIYDGFEGVKCLVDVGGGNGSILNMIITKYPAIKGINYDLASVVESSPSYPGIEHVAGDGFVTIPKGGDAIFMKWITHNWDDEHLLKLLKNCYEALPDNGKVIVVDMVVPETPETNVKAKSMLQNYLFMSSMSPQGKERTEKEFETLGKEAGFSHIRVACFLRKLDLAAQQVLVQKWRPKPLQVFSVDDSIPDQQVPWPKHFFETVSAREISTPYLWREFWMHGGFEGVKTLVDVGSDDGSVLNMIISNYPAVKGIDYDLAQL

SEQ ID NO: 391 - protein, 364 aa, Populus x generosa
  misc_feature (1)..(364): Public GI ID no.7332271
  misc_feature (1)..(364): Bit score of 1061.0 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(364): Bit score of 1061 for HMM based on sequences of FIGURE 19.
  misc_feature (1)..(364): Functional Homolog Of Ceres ANNOT ID no. 1520476 at SEQ ID NO. 342
MGSTGETQMTPTQVSDEEAHLFAMQLASASVLPMILKTAIELDLLEIMAKAGPGAFLSTSEIASHLPTKNPDAPVMLDRILRLLASYSILTCSLKDHPDGKVERLYGLAPVCKFLTKNEDGVSVSPLCLMNQDKVLMESWYYLKDAILDGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHIDVIMLAHNPGGKERTEKEFEGLAKGAGFQGFEVMCCAFNTHVIELRKN

SEQ ID NO: 392 - protein, 364 aa, Populus x generosa
  misc_feature (1)..(364): Public GI ID no.444327
  misc_feature (1)..(364): Bit score of 1056.0 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(364): Bit score of 1056 for HMM based on sequences of FIGURE 19.
  misc_feature (1)..(364): Functional Homolog Of Ceres ANNOT ID no. 1520476 at SEQ ID NO. 342
MGSTGETQMTPTQVSDEEAHLFAMQLASASVLPMILKTAIELDLLEIMAKAGPGAFLSTSEIASHLPTKNPDAPVMLDRILRLLASYSILICSLKDHPDGKVERLYGLAPVCKFLTKNEDGVSVSPLCLMNQDKVLMESWYYLKDAILDGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHIDVIMLAHNPGGKERTEKEFEGLAKGAGFQGFEVMCCAFNTHVIELRKN

SEQ ID NO: 393 - protein, 363 aa, Arabidopsis thaliana
  misc_feature (1)..(363): Public GI ID no.15239571
  misc_feature (1)..(363): Bit score of 1011.4 for HMM based on sequences of FIGURE 19.
  misc_feature (34)..(83): Pfam Name: Dimerisation Pfam Description: Dimerisation domain
  misc_feature (92)..(338): Pfam Name: Methyltransf_2 Pfam Description: O-methyltransferase
  misc_feature (92)..(338): Pfam Name: Methyltransf_2 Pfam Description: O-methyltransferase
  misc_feature (1)..(363): Bit score of 1011.4 for HMM based on sequences of FIGURE 19.
  misc_feature (1)..(363): Functional Homolog Of Ceres ANNOT ID no. 1520476 at SEQ ID NO. 342
MGSTAETQLTPVQVTDDEAALFAMQLASASVLPMALKSALELDLLEIMAKNGSPMSPTEIASKLPTKNPEAPVMLDRILRLLTSYSVLTCSNRKLSGDGVERIYGLGPVCKYLTKNEDGVSIAALCLMNQDKVLMESWYHLKDAILDGGIPFNKAYGMSAFEYHGTDPRFNKVFNNGMSNHSTITMKKILETYKGFEGLTSLVDVGGGIGATLKMIVSKYPNLKGINFDLPHVIEDAPSHPGIEHVGGDMFVSVPKGDAIFMKWICHDWSDEHCVKFLKNCYESLPEDGKVILAECILPETPDSSLSTKQVVHVDCIMLAHNPGGKERTEKEFEALAKASGFKGIKVVCDAFGVNLIELLKKL

SEQ ID NO: 394 - protein, 363 aa, Arabidopsis thaliana
  misc_feature (1)..(363): Public GI ID no.2781394
  misc_feature (1)..(363): Bit score of 1005.7 for HMM based on sequences of FIGURE 19.
  misc_feature (34)..(83): Pfam Name: Dimerisation Pfam Description: Dimerisation domain
  misc_feature (92)..(338): Pfam Name: Methyltransf_2 Pfam Description: O-methyltransferase
  misc_feature (92)..(338): Pfam Name: Methyltransf_2 Pfam Description: O-methyltransferase
  misc_feature (1)..(363): Bit score of 1005.7 for HMM based on sequences of FIGURE 19.
  misc_feature (1)..(363): Functional Homolog Of Ceres ANNOT ID no. 1520476 at SEQ ID NO. 342
MGSTAETQLTPVQVTDDEAALFAMQLASASVLPMALKSALELDLLEIMAKNGSPMSPTEIASKLPTKNPEAPVMLDRILRLLTSYSVLTCSNRKLSGDGVERIYGLGPVCKYLTKNEDGVSIAALCLMNQDKVLMESWYHLKDAILDGGIPFNKAYGMSAFEYHGTDPRFNKVFNNGMSNHSTITMKKILETYKGFEGLTSLVDVGGGIGATLKMIVSKYPNLKGINFNLPHVIEDAPSHPGIEHVGGDMFVSVPKGDAIFMKWICHDWSDEHCVKFLKNCYESLPEDGKVILAECILPETPDSSLSTKQVVHVDCIMLAHNPGGKERTEKEFEALAKASGFKGIKVVCDAFGVNLIELLKKL

SEQ ID NO: 395 - protein, 352 aa, Arabidopsis thaliana
  misc_feature (1)..(352): Public GI ID no.15223364
  misc_feature (1)..(352): Bit score of 529.2 for HMM based on sequences of FIGURE 19.
  misc_feature (21)..(71): Pfam Name: Dimerisation Pfam Description: Dimerisation domain
  misc_feature (79)..(327): Pfam Name: Methyltransf_2 Pfam Description: O-methyltransferase
  misc_feature (1)..(352): Bit score of 529.2 for HMM based on sequences of FIGURE 19.
  misc_feature (1)..(352): Functional Homolog Of Ceres ANNOT ID no. 1520476 at SEQ ID NO. 342
MEEQNLSSYAMILSSSSVLPMVLKTAIDLGLFDILAESGPSSASQIFSLLSNETKKHHDSSLVNRILRFLASYSILTCSVSTEHGEPFAIYGLAPVAKYFTKNQNGGGSLAPMVNLFQDKVVTDMWYNLKDSVLEGGLPFNNTHGSSAVELVGSDSRFREVFQSSMKGFNEVFIEEFLKNYNGFDGVKSLVDVGGGDGSLLSRIISKHTHIIKAINFDLPTVINTSLPSPGIEHVAGDMFTNTPKGEAIFMKWMLHSWDDDHCVKILSNCYQSLPSNGKVIVVDMVIPEFPGDTLLDRSLFQFELFMMNMNPSGKERTKKEFEILARLAGFSNVQVPFTSLCFSVLEFHKNK

SEQ ID NO: 396 - DNA, 1363 bp, Brassica napus
  misc_feature (1)..(1363): Ceres CLONE ID no.1128033
  misc_feature (1)..(1363): Encodes the peptide sequence at SEQ ID NO 397
atcgaaacccaaaaacaaagcattctaaaatctcagaaatttcacgaaaatgggctcaacggcagagacacattcaactccagtgcaagtcaccgacgacgaaactgctctctttgccatacagttagccagtgcctcagttctccctatggctttaaaatcagctatagagctcgatcttctagagatcatggccaggaactgttctcccatgtctgcatctgagatctcttctcatcttccgaccaaaaaccccgaagctccggtcatgcttgaccgtatcctccgtcttcttacggcttactccgtcctcacttgctccgtccgtacacttcccgacggcgtcgaccggctttacgggcttggtccagtttgcaaatatttcatcaagaacgaagatggcgtctcgatagctcctctctgtctcctgaatcatgacaaggtcttcatgggcagctggtactatttgaaggatgcagttcttgatggtgggattccattcaataaagcttatggcatgagcgcgtttgagtaccatgggactgacctgagattcaacaaggttttcaacaatggaatgtctaaccattccaccatcaccatgaagaagattcttgagacctataatggttttgagggtttggtctccttggttgatgtcgggggtggcattggtgctactctcaaaatgattgtctctaagtaccctaatcttaaaggcatcaactttgatctccctcatgtcatcgaagatgctccttctcatcccggtgttgagcatgttggaggagatatgtttgtaagtgttcccaaaggtgatgctattttcatgaagtggatatgccatgactggagtgacgaacactgtttaaaattcttaaagaattgttacgaggcgcttccagagaatggaaaagtgatcttggcagagtgtatacttccagagacactagactcgagcctgtcgaccaaacaagtagtcaatgtcgattgcattatgttggctctcaatcctggaggcaaagaacggaccgagaaagagtatgaggcattagccaaaggatcaggctttgaaggcatcaaagttgtttgcaacgtttttggtgttcacgtcattgagctgctcaagaagatctgagaaaaagctttcttagtggtgctttataaataagcatgcatgctctctcttgtacgtctacttcaccagcttaattgttgtacttatgtgatcttttccgatttaaagtcttagactatgatgcttaatcatggttgccgtgcgacctgtttatcaataaattgtacttgtgtttttatttctaagaataatataaaacaatcctctataaaaaaaaaaaaaaaa

SEQ ID NO: 397 - protein, 362 aa, Brassica napus
  misc_feature (1)..(362): Ceres CLONE ID no.1128033
  misc_feature (1)..(362): Bit score of 972.0 for HMM based on sequences of FIGURE 19.
  misc_feature (34)..(83): Pfam Name: Dimerisation Pfam Description: Dimerisation domain
  misc_feature (94)..(337): Pfam Name: Methyltransf_2 Pfam Description: O-methyltransferase
  misc_feature (94)..(337): Pfam Name: Methyltransf_2 Pfam Description: O-methyltransferase
  misc_feature (1)..(362): Bit score of 972 for HMM based on sequences of FIGURE 19.
  misc_feature (1)..(362): Functional Homolog Of Ceres ANNOT ID no. 1520476 at SEQ ID NO. 342
MGSTAETHSTPVQVTDDETALFAIQLASASVLPMALKSAIELDLLEIMARNCSPMSASEISSHLPTKNPEAPVMLDRILRLLTAYSVLTCSVRTLPDGVDRLYGLGPVCKYFIKNEDGVSIAPLCLLNHDKVFMGSWYYLKDAVLDGGIPFNKAYGMSAFEYHGTDLRFNKVFNNGMSNHSTITMKKILETYNGFEGLVSLVDVGGGIGATLKMIVSKYPNLKGINFDLPHVIEDAPSHPGVEHVGGDMFVSVPKGDAIFMKWICHDWSDEHCLKFLKNCYEALPENGKVILAECILPETLDSSLSTKQVVNVDCIMLALNPGGKERTEKEYEALAKGSGFEGIKVVCNVFGVHVIELLKKI

SEQ ID NO: 398 - DNA, 1368 bp, Brassica napus
  misc_feature (1)..(1368): Ceres CLONE ID no.1118817
  misc_feature (1)..(1368): Encodes the peptide sequence at SEQ ID NO 399
atcacacaatcctctcaaacacaaagcattctaagaatatcttaaagatttcaagaaaaaaacatggggttaacggaggagacacagataactccggtgcaagtcaccgacgatgaagctgctctcttcgccatgcagctagcaagcgcctccgttcttccgatggttttaaaaacggctttagacctcgatcttctcgagatcatggccaagaactcttctcagatgtctccctctgagattgcttctcaacttcagaccaaaaaccctgaagctccaatcatgctcgaccgtatccttcgtcttcttacgtcttactccatcctcacctgctccagtcgtactattcccggcggcgacagcgtcgagaggatttacgggcttggtccggtttgcaagtatttgaccaagaacgaggatggtgtgtccattgctgctctctgtcttatgaaccaagacaaggttctcttggaaagctggtaccatttgaaagatgcaattcttgatggtgggattccattcaacaaggcctatggaatgagcgctttcgagtaccatgggaaggaccttaggttcaacacggtgttcaacaatggaatttctaaccattcaaccatcacaatgaagaagattcttgagacctataagggtttcgaaggactgacttctttggtggatgttggtggtggcattggtgcgactctcaaaatgattgtctctaagtaccctaaccttaaaggcatcaactttgatctccctcatgtcatcgaagaagctacttctcatcccggtattgagcatgttggaggagatatgtttgtaagtgtccctgaaggtgatgcaattttcatgaagtggatatgccacgattggagcgacaaacattgcgtgaaattcttgaagaactgctacgaggcgcttccagaggatggaaaagtgatattagcagagtgtatactaccagagacaccagactcgagcctgtcgacaaaacaagtagtccatgtggactgcatcatgttggctcacaaccctggtggcaaagaacggaccgagaaagagttcgagaggttagctaaagaatcaggcttcaaaggcatcaaagttgcttgcaacgcttttggtgtttacgttattgagttgctcaagaagatctaaacactgctcccatgtcttatgtctacgtcaacttcaccacctttgtcatgatgtttaataatggtttataaagagattgatctagagtttttcattgatctggttgtattgatataatcttatttgtgtttttgtttgtttggaaaacaatcatgtaattttatatttaaaaataaaataatgagattgaatcgaaaaaaaaaaaaaaaa

SEQ ID NO: 399 - protein, 364 aa, Brassica napus
  misc_feature (1)..(364): Ceres CLONE ID no.1118817
  misc_feature (1)..(364): Bit score of 970.9 for HMM based on sequences of FIGURE 19.
  misc_feature (34)..(83): Pfam Name: Dimerisation Pfam Description: Dimerisation domain
  misc_feature (94)..(339): Pfam Name: Methyltransf_2 Pfam Description: O-methyltransferase
  misc_feature (94)..(339): Pfam Name: Methyltransf_2 Pfam Description: O-methyltransferase
  misc_feature (1)..(364): Bit score of 970.9 for HMM based on sequences of FIGURE 19.
  misc_feature (1)..(364): Functional Homolog Of Ceres ANNOT ID no. 1520476 at SEQ ID NO. 342
MGLTEETQITPVQVTDDEAALFAMQLASASVLPMVLKTALDLDLLEIMAKNSSQMSPSEIASQLQTKNPEAPIMLDRILRLLTSYSILTCSSRTIPGGDSVERIYGLGPVCKYLTKNEDGVSIAALCLMNQDKVLLESWYHLKDAILDGGIPFNKAYGMSAFEYHGKDLRFNTVFNNGISNHSTITMKKILETYKGFEGLTSLVDVGGGIGATLKMIVSKYPNLKGINFDLPHVIEEATSHPGIEHVGGDMFVSVPEGDAIFMKWICHDWSDKHCVKFLKNCYEALPEDGKVILAECILPETPDSSLSTKQVVHVDCIMLAHNPGGKERTEKEFERLAKESGFKGIKVACNAFGVYVIELLKKI

SEQ ID NO: 400 - DNA, 1202 bp, Brassica napus
  misc_feature (1)..(1202): Ceres CLONE ID no.1091294
  misc_feature (1)..(1202): Encodes the peptide sequence at SEQ ID NO 401
atcacacactcctctcaaaacagagaaacaaaagaaaaagaaacatcccaagaatatcttagagatttcaagaaaaatgggatcaacggcggagacacagataactccggtacaagtcaccgacgacgaagccgctctctttgccatgcagctagccagcgcctccgtccttcccatggttttaaagtccgcgctagaccttgatcttctcgagatcatggccaagaactcttctccgatgtctccctctgagattgcttctaaacttcagaccaaaaaccccgaagctccggtcatgctcgaccgaatcctccgtcttctcacgtcttactccatcctcacctgctccaaccgaaccattcccggcggagacagcgtcgagaggatctacgggcttggtccggtttgcaagtaccatttgaaagatgcagttcttgatggtgggattccattcaacaaggcttatggaatgagcgcttttgagtaccacgggaaggatctaaggttcaacacggtcttcaacaatggaatgtctaaccattcaaccatcacaatgaagaagattctcgagacctacaagggttttgagggtttgacttctttggttgacgttgggggtggcattggtgctactctcaaaatgattgtctctaagtaccctgaccttaaaggcatcaactttgatctcccacatgtcatcgaagaagctacttctcatcccggtattgatcatgttggaggagatatgtttgtaagcgtccctaaaggtgatgctattttcatgaagtggatatgccacgactggagcgatgaacactgcgtgaaattcttgaagaactgctacgaggcgcttccagaggatggaaaagtgatactagcagagtgtatacttccagagacaccagactcaagcctctcgactaaacaagtagtccatgttgattgcattatgctggctcacaaccctggaggcaaagagaggaccgagaaagagttcgaagcattagctaaaggatcaggcttcaaagggatcaatgttgcctgcaatgcttttggtgtttacgttattgagctgctcaaaaagatgtaaaacacacacgcacaatccatgtaataatgattttatatgtaaacaatgctcttatgtacgtctacttcaccgtcaaaaaaaaaaaaaaaaaaaaagaaaaaaaaaaaaaaaa

SEQ ID NO: 401 - protein, 337 aa, Brassica napus
  misc_feature (1)..(337): Ceres CLONE ID no.1091294
  misc_feature (1)..(337): Bit score of 859.8 for HMM based on sequences of FIGURE 19.
  misc_feature (113)..(312): Pfam Name: Methyltransf_2 Pfam Description: O-methyltransferase
  misc_feature (34)..(83): Pfam Name: Dimerisation Pfam Description: Dimerisation domain
  misc_feature (1)..(337): Bit score of 859.8 for HMM based on sequences of FIGURE 19.
  misc_feature (1)..(337): Functional Homolog Of Ceres ANNOT ID no. 1520476 at SEQ ID NO. 342
MGSTAETQITPVQVTDDEAALFAMQLASASVLPMVLKSALDLDLLEIMAKNSSPMSPSEIASKLQTKNPEAPVMLDRILRLLTSYSILTCSNRTIPGGDSVERIYGLGPVCKYHLKDAVLDGGIPFNKAYGMSAFEYHGKDLRFNTVFNNGMSNHSTITMKKILETYKGFEGLTSLVDVGGGIGATLKMIVSKYPDLKGINFDLPHVIEEATSHPGIDHVGGDMFVSVPKGDAIFMKWICHDWSDEHCVKFLKNCYEALPEDGKVILAECILPETPDSSLSTKQVVHVDCIMLAHNPGGKERTEKEFEALAKGSGFKGINVACNAFGVYVIELLKKM

SEQ ID NO: 402 - protein, 365 aa, Fragaria x ananassa
  misc_feature (1)..(365): Public GI ID no.6760443
  misc_feature (1)..(365): Bit score of 1051.3 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1051.3 for HMM based on sequences of FIGURE 19.
  misc_feature (1)..(365): Functional Homolog Of Ceres ANNOT ID no. 1520476 at SEQ ID NO. 342
MGSTGETQMTPTHVSDEEANLFAMQLASASVLPMVLKAAIELDLLEIMAKAGPGSFLSPSDLASQLPTKNPEAPVMLDRMLRLLASYSILTCSLRTLPDGKVERLYCLGPVCKFLTKNEDGVSIAALCLMNQDKVLVESWYHLKDAVLDGGIPFNKAYGMTAFDYHGTDPRFNKVFNKGMADHSTITMKKILETYKGFEGLKSIVDVGGGTGAVVNMIVSKYPSIKGINFDLPHVIEDAPQYPGVQHVGGDMFVSVPKGNAIFMKWICHDWSDEHCIKFLKNCYAALPDDGKVILAECILPVAPDTSLATKGVVHMDVIMLAHNPGGKERTEQEFEALAKGSGFQGIRVCCDAFNTYVIEFLKKI

SEQ ID NO: 403 - protein, 365 aa, Malus x domestica
  misc_feature (1)..(365): Public GI ID no.114199048
  misc_feature (1)..(365): Bit score of 1038.0 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1038 for HMM based on sequences of FIGURE 19.
  misc_feature (1)..(365): Functional Homolog Of Ceres ANNOT ID no. 1520476 at SEQ ID NO. 342
MGSTPETQMTPTQVSDEEANLFAMQLASASVLPMVLKAAIELDLLEIMAKAGPGAFVSPADLSSQLPTKNPDAPVMLDRMLRVLASYSILTYSLRTLPDGKVERLYGLGPVCKFLTKSEDGASIGSLCLMNQDKVLMESWYNLKDAVLEGGIPFNKAYGMTAFEYHGTDPRFNKVFNKGMADHSTITMKKLLENYNGFEGLTSIVDVGGGTGAVLNMIVSKYPSIKGINFDLPHVIEDAPQYPGVEHVGGDMFVSVPKGDAIFMKWICHDWSDEHCLKFLKNCHAALPDNGKVIVAECILPVAPDTSLATKGVVHIDAIMLAHNPGGKERTEKEFEALAKGSGFQGFRVVCSAFNTYAIEFLKKN

SEQ ID NO: 404 - protein, 365 aa, Malus x domestica
  misc_feature (1)..(365): Public GI ID no.114199044
  misc_feature (1)..(365): Bit score of 1033.5 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1033.5 for HMM based on sequences of FIGURE 19.
  misc_feature (1)..(365): Functional Homolog Of Ceres ANNOT ID no. 1520476 at SEQ ID NO. 342
MGSTPETQMTPTQVSDEEANLFAMQLASASVLPMVLKAAIELDLLEIMAKAGPGAFVSPADLSSQLPTKNPDAPVMLDRMLRVLASYSILTYSLRTLPDGKVERLYGLGPVCKFLTKSVDGASIGSLCLMNQDKVLMESWYNLKDAVLEGGIPFNKAYGMTAFEYHGTDPRFNRVFNKGMADHSTITMKKLLENYNGFEGLTSIVDVGGGTGAVLNMIVSKYPSIKGINFDLPHVIEDAPQYPGVEHVGGDMFVSVPKGDAIFMKWICHDWSDEHCLKFLKNCYAALPDNGKVIVAECILPVAPDSSLATKGVVHIDAIMLAHNPGGKERTEKEFEALAKGSGFQGFRVVCSAFNTYAIEFLKKN

SEQ ID NO: 405 - protein, 365 aa, Malus x domestica
  misc_feature (1)..(365): Public GI ID no.114199046
  misc_feature (1)..(365): Bit score of 991.5 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 991.5 for HMM based on sequences of FIGURE 19.
  misc_feature (1)..(365): Functional Homolog Of Ceres ANNOT ID no. 1520476 at SEQ ID NO. 342
MGLTPEIQMTPTQVSDEEANLFAMQLATGSILHMVLKAAIELDLLEIMAKAGPGAFVSPADLSSQLPTKNPDSPVMLDRMLRLLASYSILTYSLRTLPDGKVERLYGLGPVCKFLTKNEDGASIGSLCLLIQDKVLMESWYHLKDAVLEGGIPFNKAYGMTAFEYHGTEPRFNKVFNKGMADNSTITMKKLLENYNGFEGLTSIVDVGGGTGAVLNMIVSKYPSIKGINFDLPHVIEDAPQYPGVEHVGGDMFVSVPKGDAIFMKWICHDWTDEHCLKFLKNCYAALPDNGKVIVAEYILPVAPDGSLATKEVVHSDAIMLAHNPGGKERTEKEFEALAKGSGFQGFRVVCSAFNTYAIEFLKKN

SEQ ID NO: 406 - protein, 365 aa, Malus x domestica
  misc_feature (1)..(365): Public GI ID no.114199050
  misc_feature (1)..(365): Bit score of 991.4 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 991.4 for HMM based on sequences of FIGURE 19.
  misc_feature (1)..(365): Functional Homolog Of Ceres ANNOT ID no. 1520476 at SEQ ID NO. 342
MGSTPETQMTPTQVSDEEANLFAMQLATGSILHMVLKAAIELDLLEIMAKAGPGAFVSPADLSSQLPTKNPDSPVMLDRMLRLLASYSILTYSHRTLPDGKVERLYGLGPVCKFLTKNEDGASIGSLCLLIQDKVLMESWYHLKDAVLEGGIPFNKAYGITAFEYHGTDPRFNKVFNKGMADNSTITMKKLLENYNGFEGLTSIVDVGGGTGAVLNMIVSKYPSIKGINFDLPHVIEDAPQYPGVEHVGGDMFVSVSKGDAIFMKWICHDWSDEHCLKFLKNCYAALPDNGKVIVAEYILPVAPDGSLATKEVVHSDAIMLAHNPGGKERTEKEFEALAKGSGFQGFRVVCSAFNTYAIEFLKKS

SEQ ID NO: 407 - protein, 365 aa, Prunus dulcis
  misc_feature (1)..(365): Public GI ID no.3913295
  misc_feature (1)..(365): Bit score of 1064.6 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1064.6 for HMM based on sequences of FIGURE 19.
  misc_feature (1)..(365): Functional Homolog Of Ceres ANNOT ID no. 1520476 at SEQ ID NO. 342
MGSTGETQMTPTQVSDEEANLFAMQLASASVLPMVLKAAIELDLLEIMAKAGPGVFLSPTDIASQLPTKNPDAPVMLDRMLRLLASYSILTYSLRTLADGKVERLYGLGPVCKFLTKNEEGVSIAPLCLMNQDKVLLESWYHLKDAVLEGGIPFNKAYGMTAFEYHGTDPRFNKVFNRGMADHSTITMKKILETYKGFEGLTSVVDVGGGTGAVLNMIVSKYPSIKGINFDLPHVIEDAPQYPGVEHVGGDMFVSVPKGDAIFMKWICHDWSDEHCLKFLKNCYAALPDNGKVILGECILPVAPDSSLATKGVVHIDVIMLAHNPGGKERTEQEFQALAKGAGFQGFNVACSAFNTYVIEFLKKN

SEQ ID NO: 408 - DNA, 1384 bp, Glycine max
  misc_feature (1)..(1384): Ceres CLONE ID no.535888
  misc_feature (1)..(1384): Encodes the peptide sequence at SEQ ID NO 409
aagcacgatcattgcgtggtttaacatctatagaatggaaaaataaacaagaaagcaactaagtgtactagtttaagcagtagaagtggaaagtggttgcagagtagaagtcgagatggccaaccttccaaattcaaagctttatgggaaagagaagatgaaaggagagcaagaattagaagatgaagaaagcttctcgcgtgctatgctgctttgcagctccgttgtggtttccatggcgctgcaatcggcaacggagctgggcgtatttgacgtgttgcaagaagcgggggctaagctctctgcgaaagagatagcatccaagctttcctgcgacaacaaccctgaagcagactcaatgctggatcgccttctagcccttctagcctctcactccattcttaactgttctctcattctcgaccaccaaaacctggggacctttcagaggctctacaccatcactcccgtcgccagattctttgctcgcaattctgatggggtttccttgggacccttgatggccttgcttcaagacaagatcttcctacatagctggtcggagctgaaagattcaattcgggaagggggtattccattcaacagggtttatggcactcatgcttttgagtatccaaggttggacgcaaggttcaatcaagtttttaacacagcaatgatcaatcacaccactatagtgatgaagaaggttctggagtgctacaaaggttttgagaacataaaaatgcttgtggatgttggtggtggtcttgggatcaacatcaacttgatcacttccaaataccctcatatccagggtatcaattttgacttgcctcatgtcctagaacatgctccttcctatcctggagtggaacacgttggcggagatatgtttgaaaatgtgcctaaaggagacgccatctttatgaagtggatacttcatgattggagtgatgaatactgtctgaagttgttgaagaactgctatgacgcaattcctgatgatggaaaggtgatagttgtggaggcagttcttccaattataccagagacgtcaaatgctgcttggaaggccgtttcccaaacggatgttctgatgatgactcaaaacccgggaggcaaagagcgatctgatcaagaattcatggatttggcaactgcagctggatttagtggcatcagatatgaatgctatgttcgaaccttttggatcatggagttcttcaagtaaacaaccatatactactctgcatgcccctttatgcttttcgtcatttttaattaacaaaacacgctcaggtgtgtattatcataagtttgtttttttttaaataattatctgatgaaatctaattcagtttacaaaaaaaaaaaaaaaaaa

SEQ ID NO: 409 - protein, 358 aa, Glycine max
  misc_feature (1)..(358): Ceres CLONE ID no.535888
  misc_feature (1)..(358): Bit score of 821.1 for HMM based on sequences of FIGURE 19.
  misc_feature (27)..(77): Pfam Name: Dimerisation Pfam Description: Dimerisation domain
  misc_feature (89)..(335): Pfam Name: Methyltransf_2 Pfam Description: O-methyltransferase
  misc_feature (1)..(358): Bit score of 821.1 for HMM based on sequences of FIGURE 19.
  misc_feature (1)..(358): Functional Homolog Of Ceres ANNOT ID no. 1520476 at SEQ ID NO. 342
MKGEQELEDEESFSRAMLLCSSVVVSMALQSATELGVFDVLQEAGAKLSAKEIASKLSCDNNPEADSMLDRLLALLASHSILNCSLILDHQNLGTFQRLYTITPVARFFARNSDGVSLGPLMALLQDKIFLHSWSELKDSIREGGIPFNRVYGTHAFEYPRLDARFNQVFNTAMINHTTIVMKKVLECYKGFENIKMLVDVGGGLGININLITSKYPHIQGINFDLPHVLEHAPSYPGVEHVGGDMFENVPKGDAIFMKWILHDWSDEYCLKLLKNCYDAIPDDGKVIVVEAVLPIIPETSNAAWKAVSQTDVLMMTQNPGGKERSDQEFMDLATAAGFSGIRYECYVRTFWIMEFFK

SEQ ID NO: 410 - protein, 365 aa, Medicago sativa
  misc_feature (1)..(365): Public GI ID no.116908
  misc_feature (1)..(365): Bit score of 1047.6 for HMM based on sequences of FIGURE 19.
  misc_feature (34)..(85): Pfam Name: Dimerisation Pfam Description: Dimerisation domain
  misc_feature (95)..(340): Pfam Name: Methyltransf_2 Pfam Description: O-methyltransferase
  misc_feature (95)..(340): Pfam Name: Methyltransf_2 Pfam Description: O-methyltransferase
  misc_feature (1)..(365): Bit score of 1047.6 for HMM based on sequences of FIGURE 19.
  misc_feature (1)..(365): Functional Homolog Of Ceres ANNOT ID no. 1520476 at SEQ ID NO. 342
MGSTGETQITPTHISDEEANLFAMQLASASVLPMILKSALELDLLEIIAKAGPGAQISPIEIASQLPTTNPDAPVMLDRMLRLLACYIILTCSVRTQQDGKVQRLYGLATVAKYLVKNEDGVSISALNLMNQDKVLMESWYHLKDAVLDGGIPFNKAYGMTAFEYHGTDPRFNKVFNKGMSDHSTITMKKILETYTGFEGLKSLVDVGGGTGAVINTIVSKYPTIKGINFDLPHVIEDAPSYPGVEHVGGDMFVSIPKADAVFMKWICHDWSDEHCLKFLKNCYEALPDNGKVIVAECILPVAPDSSLATKGVVHIDVIMLAHNPGGKERTQKEFEDLAKGAGFQGFKVHCNAFNTYIMEFLKKV

SEQ ID NO: 411 - protein, 365 aa, Medicago truncatula
  misc_feature (1)..(365): Public GI ID no.92878636
  misc_feature (1)..(365): Bit score of 1050.4 for HMM based on sequences of FIGURE 19.
  misc_feature (34)..(85): Pfam Name: Dimerisation Pfam Description: Dimerisation domain
  misc_feature (95)..(340): Pfam Name: Methyltransf_2 Pfam Description: O-methyltransferase
  misc_feature (95)..(340): Pfam Name: Methyltransf_2 Pfam Description: O-methyltransferase
  misc_feature (1)..(365): Bit score of 1050.4 for HMM based on sequences of FIGURE 19.
  misc_feature (1)..(365): Functional Homolog Of Ceres ANNOT ID no. 1520476 at SEQ ID NO. 342
MGSTGETQITPTHISDEEANLFAMQLASASVLPMVLKSALELDLLEIIAKAGPGAQISPIEIASQLPTTNPEAPVMLDRILRLLACYNILTCSVRTQQDGKVQRLYGLATVAKYLVKNEDGVSISALNLMNQDKVLMESWYHLKDAVLDGGIPFNKAYGMTAFEYHGTDPRFNKVFNKGMSDHSTITMKKILETYTGFEGLKSLVDVGGGTGAVINTIVSKYPTIKGINFDLPHVIEDAPSYPGVEHVGGDMFVSIPKADAVFMKWICHDWSDEHCLKFLKNCYEALPDNGKVIVAECILPVAPDSSLATKGVVHIDAIMLAHNPGGKERTQKEFEDLAKGAGFQGFKVHCNAFNTYIMEFLKKV

SEQ ID NO: 412 - protein, 366 aa, Eucalyptus gunnii
  misc_feature (1)..(366): Public GI ID no.1169009
  misc_feature (1)..(366): Bit score of 1042.2 for HMM based on sequences of FIGURE 19.
  misc_feature (35)..(86): Pfam Name: Dimerisation Pfam Description: Dimerisation domain
  misc_feature (95)..(341): Pfam Name: Methyltransf_2 Pfam Description: O-methyltransferase
  misc_feature (95)..(341): Pfam Name: Methyltransf_2 Pfam Description: O-methyltransferase
  misc_feature (1)..(366): Bit score of 1042.2 for HMM based on sequences of FIGURE 19.
  misc_feature (1)..(366): Functional Homolog Of Ceres ANNOT ID no. 1520476 at SEQ ID NO. 342
MGSTGSETQMTPTQVSDEEANLFAMQLASASVLPMVLKAAIELDLLEIMAKAGPGAFLSPGEVAAQLPTQNPEAPVMLDRIFRLLASYSVLTCTLRNLPDGKVERLYGLAPVCKFLVKNEDGVSIAALNLMNQDKILMESWYYLKDAVLEGGIPFNKAYGMTAFEYHGTDPRFNKIFNRGMSDHSTITMKKILETYKGFEGLETVVDVGGGTGAVLSMIVAKYPSMKGINFDLPHVIEDAPPLPGVKHVGGDMFVSVPKGDAIFMKWICHDWSDDHCAKFLKNCYDALPNIGKVIVAECVLPVYPDTSLATKNVIHIDCIMLAHNPGGKERTQKEFETLAKGAGFQGFQVMCCAFGTHVMEFLKTA

SEQ ID NO: 413 - protein, 363 aa, Catharanthus roseus
  misc_feature (1)..(363): Public GI ID no.29839377
  misc_feature (1)..(363): Bit score of 1047.3 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(363): Bit score of 1047.3 for HMM based on sequences of FIGURE 19.
  misc_feature (1)..(363): Functional Homolog Of Ceres ANNOT ID no. 1520476 at SEQ ID NO. 342
MGSANPDNKNSMTKEEEEACLSAMRLASASVLPMVLKSAIELDLLELIKKSGPGAYVSPSELAAQLPTQNPDAPVMLDRILRLLASYSVLNCTLKDLPDGGIERLYSLAPVCKFLTKNEDGVSMAALLLMNQDKVLMESWYHLKDAVLEGGIPFNKAYGMTAFEYHGKDPRFNKVFNQGMSNHSTIIMKKILEIYQGFQGLKTVVDVGGGTGATLNMIVSKYPSIKGINFDLPHVIEDAPSYPGVDHVGGDMFVSVPKGDAIFMKWICHDWSDAHCLKFLKNCHEALPENGKVILAECLLPEAPDSTLSTQNTVHVDVIMLAHNPGGKERTEKEFEALAKGAGFRGFIKVCCAYNSWIMELLK

SEQ ID NO: 414 - protein, 359 aa, Capsicum annuum
  misc_feature (1)..(359): Public GI ID no.12003964
  misc_feature (1)..(359): Bit score of 1035.1 for HMM based on sequences of FIGURE 19.
  misc_feature (30)..(81): Pfam Name: Dimerisation Pfam Description: Dimerisation domain
  misc_feature (90)..(336): Pfam Name: Methyltransf_2 Pfam Description: O-methyltransferase
  misc_feature (90)..(336): Pfam Name: Methyltransf_2 Pfam Description: O-methyltransferase
  misc_feature (1)..(359): Bit score of 1035.1 for HMM based on sequences of FIGURE 19.
  misc_feature (1)..(359): Functional Homolog Of Ceres ANNOT ID no. 1520476 at SEQ ID NO. 342
MDSTNQNLTQTEDEAFLFAMQLASASVLPMVLKSALELDLLEIMAKAGPGAAISPSELAAQLPTKNPEAPIMLDRMLRLLATYSVLNCTLRTLPDGRVERLYSLAPVCKLLTKNADGVSVAPLLLMNQDKVLMESWYHLTDAVLDGGVPFNKAYGMTAFEYHGTDPRFNKVFNRGMSDHSTMTMKKILEDYKGFEGLNSIVDVGGGTGATVNMIVSKYPSIKGINFDLSHVIEDAPAYPGVEHVGGDMFVSVPKADAIFMKWICHDWSDEHCLKFLKNCYEALPANGKVLVAECILPETPDTSAATKNAVHVDIVMLAHNPGGKERTEKEFEALAKGAGFTGFRRACCAYQTWVMEFHK

SEQ ID NO: 415 - protein, 359 aa, Capsicum annuum
  misc_feature (1)..(359): Public GI ID no.30315948
  misc_feature (1)..(359): Bit score of 1027.1 for HMM based on sequences of FIGURE 19.
  misc_feature (30)..(81): Pfam Name: Dimerisation Pfam Description: Dimerisation domain
  misc_feature (90)..(336): Pfam Name: Methyltransf_2 Pfam Description: O-methyltransferase
  misc_feature (90)..(336): Pfam Name: Methyltransf_2 Pfam Description: O-methyltransferase
  misc_feature (1)..(359): Bit score of 1027.1 for HMM based on sequences of FIGURE 19.
  misc_feature (1)..(359): Functional Homolog Of Ceres ANNOT ID no. 1520476 at SEQ ID NO. 342
MDSTNQNLTQTEDEAFLFAMQLASASVLPMVLKSALELDLLEIMAKAGPGAAISPSELAAQLPTKNPEAPVMLDRMLRLLATYSVLNCTLRTLPDGRVERLYSLAPVCKLLTKNADGVSVAPLLLMNQDKVLMESWYHLTDAVLDGGVPFNKAYGMTAFEYHGTDPRFNKVFNRGMSDHSTMTMKKILEDYKGFEGLNSIVDVGGGTGATVNMIVSKYPSIKGINFDLSHVIEDAPAYPGVEHVGRDMFVSVPKADAIFMKWICHDWSDEHCLKFLKNCYEALPANGKVLVAECILPETPDTSAATKNAVHVDIVMLAHNPGGKERTEKEFEALAKGAGFTGFRRACCAYQTWVMEFHK

SEQ ID NO: 416 - protein, 364 aa, Nicotiana tabacum
  misc_feature (1)..(364): Public GI ID no.396589
  misc_feature (1)..(364): Bit score of 993.4 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(364): Bit score of 993.4 for HMM based on sequences of FIGURE 19.
  misc_feature (1)..(364): Functional Homolog Of Ceres ANNOT ID no. 1520476 at SEQ ID NO. 342
MGSTSESQSNSLTHTEDEAFLFAMQLCSASVLPMVLKSAVELDLLELMAKAGPGAAISPSELAAQLSTQNPEAPVMLDRMLRLLASYSVLNCTLRTLPDSSVERLYSLAPVCKYLTKNADGVSVAPLLLMNQDKVLMESWYHLKDAVLDGGIPFNKAYGMTAFEYHGTDPRFNKVFNRGMSDHSTMSMKKILEDYKGFEGLNSIVDVGGGTGATVNMIVSKYPSIKGINFDLPHVIGDAPTYPGVEHVGGDMFASVPKADAIFMKWICHDWSDEHCLKFLKNCYEALPANGKVIIAECILPEAPDTSLATKNTVHVDIVMLAHNPGGKERTEKEFEALAKGAGFTGFARLVALTTLGSWNSTSN

SEQ ID NO: 417 - protein, 364 aa, Nicotiana tabacum
  misc_feature (1)..(364): Public GI ID no.396591
  misc_feature (1)..(364): Bit score of 985.0 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(364): Bit score of 985 for HMM based on sequences of FIGURE 19.
  misc_feature (1)..(364): Functional Homolog Of Ceres ANNOT ID no. 1520476 at SEQ ID NO. 342
MGSTSQSQSKSLTHTEDEAFLFAMQLASASVLPMVLKSALELDLLELMAKAGPGAAISPSELAAQLSTQNPEAPVILDRMLRLLATYSVLNCTLRTLSDGSVERLYSLAPVCKFLTKNADGVSVAPLLLMNQDKVLMESWYHLKDAVLDGGIPFNKAYGMTAFEYHGTDPRFNKVFNRGMSDHSTMSMKKILEDYKGFEGLNSIVDVGGGTGATVNMIVSKHPSIKGINFDLPHVIGDAPAYPGVEHVGGDMFASVPKADAIFMKWICHDWSDEHCLKFLKNCYEALPANGKVIIAECILPEAPDTSLATKNTVHVDIVMLAHNPGGKERTEKEFEALAKGAGFTGFARLVALTTLGSWNSTNN

SEQ ID NO: 418 - protein, 367 aa, Liquidambar styraciflua
  misc_feature (1)..(367): Public GI ID no.5732000
  misc_feature (1)..(367): Bit score of 1037.7 for HMM based on sequences of FIGURE 19.
  misc_feature (36)..(87): Pfam Name: Dimerisation Pfam Description: Dimerisation domain
  misc_feature (96)..(342): Pfam Name: Methyltransf_2 Pfam Description: O-methyltransferase
  misc_feature (96)..(342): Pfam Name: Methyltransf_2 Pfam Description: O-methyltransferase
  misc_feature (1)..(367): Bit score of 1037.7 for HMM based on sequences of FIGURE 19.
  misc_feature (1)..(367): Functional Homolog Of Ceres ANNOT ID no. 1520476 at SEQ ID NO. 342
MGSTSETKMSPSEAAAAEEEAFVFAMQLTSASVLPMVLKSAIELDVLEIMAKAGPGAHISTSDIASKLPTKNPDAAVMLDRMLRLLASYSVLTCSLRTLPDGKIERLYGLAPVCKFLTRNDDGVSIAALSLMNQDKVLMESWYHLTEAVLEGGIPFNKAYGMTAFEYHGTDPRFNTVFNNGMSNHSTITMKKILETYKGFEGLGSVVDVGGGTGAHLNMIIAKYPMIKGINFDLPHVIEEAPSYPGVEHVGGDMFVSVPKGDAIFMKWICHDWSDEHCLKFLKKCYEALPTNGKVILAECILPVAPDASLPTKAVVHIDVIMLAHNPGGKERTEKEFEALAKGAGFEGFRVALCAYNTWIIEFLKKI

SEQ ID NO: 419 - protein, 352 aa, Hordeum vulgare
  misc_feature (1)..(352): Public GI ID no.27531337
  misc_feature (1)..(352): Bit score of 790.2 for HMM based on sequences of FIGURE 19.
  misc_feature (21)..(74): Pfam Name: Dimerisation Pfam Description: Dimerisation domain
  misc_feature (83)..(329): Pfam Name: Methyltransf_2 Pfam Description: O-methyltransferase
  misc_feature (1)..(352): Bit score of 790.2 for HMM based on sequences of FIGURE 19.
  misc_feature (1)..(352): Functional Homolog Of Ceres ANNOT ID no. 1520476 at SEQ ID NO. 342
MANEEALMFALQLASSVVLPMTLRTCIELGLLETLVGAGGKTLTPEEVAAKLPSKAESNPDAASMVDRLLRVLATYKVVSRLVDECADGSLSRRYGAEPVCKWLTPNEDGVSMAPFCLLAQNKLFMEAWCHMKDAVLEGGSAFTKAFRASWFDYAGTDDHFNHLFNEAMKDHSVIITKKPLELYTGFDGIDTLVDLAGGVGAVIHAITKKYPSIKGINFDLPHVISDAQPYPGVEHVGGDMFEMVPSGDAIPMKWILPCFSDDECAVLLKNCYDALPAHGKVINVECILPVNPDATNNAQGLICVDASLLAYSPGGKERNLRDFEKLAKAAGFTGVKASYIFANFWAMEYTK

SEQ ID NO: 420 - protein, 360 aa, Lolium perenne
  misc_feature (1)..(360): Public GI ID no.2388664
  misc_feature (1)..(360): Bit score of 925.9 for HMM based on sequences of FIGURE 19.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 925.9 for HMM based on sequences of FIGURE 19.
  misc_feature (1)..(360): Functional Homolog Of Ceres ANNOT ID no. 1520476 at SEQ ID NO. 342
MGSTAADMAASADEDVALFALQLASSSVLPMTLKNAIELGLLEILVAAGGKSLTPTEVAAKLPSAVNPEAPDMVDRILRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFQGLGTLVDVGGGVGATVAAIAAHYPAIKGVNFDLPHVISEAPQFPGVTHVGGDMFKEVPSGDAILMKWILHDWSDQHCATLLKNCYDALPANGKVVLVECILPVNPEANPSSQGVFHVDMIMLAHNPGGRERYEREFQALARGAGFTGVKSTYIYANAWAIEFTK

SEQ ID NO: 421 - protein, 360 aa, Lolium perenne
  misc_feature (1)..(360): Public GI ID no.4104220
  misc_feature (1)..(360): Bit score of 924.2 for HMM based on sequences of FIGURE 19.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 924.2 for HMM based on sequences of FIGURE 19.
  misc_feature (1)..(360): Functional Homolog Of Ceres ANNOT ID no. 1520476 at SEQ ID NO. 342
MGSTAADMAASADEDACMFALQLASSSVLPMTLKNAIELGLLEILVAAGGKSLTPTEVAAKLPSAANPEAPDMVDRILRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFEGLGTLVDVGGGVGATVAAIAAHYPTIKGVNFDLPHVISEAPQFPGVTHVGGDMFKEVPSGDTILMKWILHDWSDQHCATLLKNCYDALPAHGKVVLVQCILPVNPEANPSSQGVFHVDMIMLAHNPGGRERYEREFQALARGAGFTGVKSTYIYANAWAIEFTK

SEQ ID NO: 422 - protein, 361 aa, Lolium perenne
  misc_feature (1)..(361): Public GI ID no.4104224
  misc_feature (1)..(361): Bit score of 911.8 for HMM based on sequences of FIGURE 19.
  misc_feature (31)..(83): Pfam Name: Dimerisation Pfam Description: Dimerisation domain
  misc_feature (92)..(338): Pfam Name: Methyltransf_2 Pfam Description: O-methyltransferase
  misc_feature (92)..(338): Pfam Name: Methyltransf_2 Pfam Description: O-methyltransferase
  misc_feature (1)..(361): Bit score of 911.8 for HMM based on sequences of FIGURE 19.
  misc_feature (1)..(361): Functional Homolog Of Ceres ANNOT ID no. 1520476 at SEQ ID NO. 342
MGSTAAEIAASADEEACLYALQLGSSSILPMTLKNTIELGLLETLMAAGGKSLTPTEVAAKLPCAAKNPEAPDMVDRMLRLLASYNVVSCLVEEGTDGRLSRRYGAAPVCKFLTPNEDGVSMAALALMNQDKVLMESWYYLKDAVLDGGIPFNKAYGMSAFEYHGTDPRFNRVFNEAMKNNSIIITKKLLQLYDGFQGLGTLVDVGGGVGATVAAITAHYPTIKGINFDLPHVISEAPPFPGVTHVGGDMFKKVPLGDAILMKWILHDWSDQHCGTLLKNCYDALPMHGKVVLVECILPVNPEAKPSSQGVFHVDMIMLAHNPGGRERYEREYEALARGAGFAGFKSTYIYANAWAIEFTK

SEQ ID NO: 423 - protein, 362 aa, Saccharum officinarum
  misc_feature (1)..(362): Public GI ID no.29839259
  misc_feature (1)..(362): Bit score of 942.6 for HMM based on sequences of FIGURE 19.
  misc_feature (31)..(85): Pfam Name: Dimerisation Pfam Description: Dimerisation domain
  misc_feature (94)..(339): Pfam Name: Methyltransf_2 Pfam Description: O-methyltransferase
  misc_feature (94)..(339): Pfam Name: Methyltransf_2 Pfam Description: O-methyltransferase
  misc_feature (1)..(362): Bit score of 942.6 for HMM based on sequences of FIGURE 19.
  misc_feature (1)..(362): Functional Homolog Of Ceres ANNOT ID no. 1520476 at SEQ ID NO. 342
MGSTAEDVAAVADEEACMYAMQLASASILPMTLKNALELGLLEVLQAEAPAGKALAPEEVVARLPVAPTNPDAADMVDRMLRLLASYDVVKCQMEDKDGKYERRYSAAPVGKWLTPNEDGVSMAALTLMNQDKVLMESWYYLKDAVLDGGIPFNKAYGMTAFEYHGTDPRFNRVFNEGMKNHSVIITKKLLEFYTGFEGVSTLVDVGGGIGATLHAITSHHPQIKGINFDLPHVISEAPPFPGVQHVGGDMFKSVPAGDAILMKWILHDWSDAHCATLLKNCYDALPENGKVIIVECVLPVNTEAVPKAQGVFHVDMIMLAHNPGGRERYEREFHDLAKGAGFSGFKATYIYANAWAIEFIK

SEQ ID NO: 424 - protein, 362 aa, Sorghum bicolor
  misc_feature (1)..(362): Public GI ID no.28569609
  misc_feature (1)..(362): Bit score of 916.5 for HMM based on sequences of FIGURE 19.
  misc_feature (31)..(83): Pfam Name: Dimerisation Pfam Description: Dimerisation domain
  misc_feature (92)..(339): Pfam Name: Methyltransf_2 Pfam Description: O-methyltransferase
  misc_feature (92)..(339): Pfam Name: Methyltransf_2 Pfam Description: O-methyltransferase
  misc_feature (1)..(362): Bit score of 916.5 for HMM based on sequences of FIGURE 19.
  misc_feature (1)..(362): Functional Homolog Of Ceres ANNOT ID no. 1520476 at SEQ ID NO. 342
MGSTAEDVAAVADEEACMYAMQLASSSILPMTLKNALELGLLEVLQKDAGKALAAEEVVARLPVAPTNPAAADMVDRMLRLLASYDVVRCQMEDKDGKYERRYSAAPVGKWLTPNEDGVSMAALALMNQDKVLMESWYYLKDAVLDGGIPFNKAYGMTAFEYHGTDPRFNRVFNEGMKNHSVIITKKLLEFYTGFDESVSTLVDVGGGIGATLHAITSHHSHIRGINFDLPHVISEAPPFPGVQHVGGDMFKSVPAGDAILMKWILHDWSDAHCATLLKNCYDALPEKGGKVIVVECVLPVTTDAVPKAQGVFHVDMIMLAHNPGGRERYEREFRDLAKAAGFSGFKATYIYANAWAIEFIK

SEQ ID NO: 425 - protein, 362 aa, Sorghum bicolor
  misc_feature (1)..(362): Public GI ID no.18033964
  misc_feature (1)..(362): Bit score of 912.5 for HMM based on sequences of FIGURE 19.
  misc_feature (31)..(83): Pfam Name: Dimerisation Pfam Description: Dimerisation domain
  misc_feature (92)..(339): Pfam Name: Methyltransf_2 Pfam Description: O-methyltransferase
  misc_feature (92)..(339): Pfam Name: Methyltransf_2 Pfam Description: O-methyltransferase
  misc_feature (1)..(362): Bit score of 912.5 for HMM based on sequences of FIGURE 19.
  misc_feature (1)..(362): Functional Homolog Of Ceres ANNOT ID no. 1520476 at SEQ ID NO. 342
MGSTAEDVAAVADEEACMYAMQLASSSILPMTLKNALELGLLEVLQKDAGKALAAEEVVARLPVAPTNPAAADMVDRILRLLASYDVVKCQMEDKDGKYERRYSAAPVGKWLTPNEDGVSMAALALMNQDKVLMESWYYLKDAVLDGGIPFNKAYGMTAFEYHGTDPRFNRVFNEGMKNHSVIITKKLLEFYTGFDESVSTLVDVGGGIGATLHAITSHHSHIRGVNFDLPHVISEAPPFPGVQHVGGDMFKSVPAGDAILMKWILHDWSDAHCATLLKNCYDALPEKGGKVIVVECVLPVTTDAVPKAQGVFHVDMIMLAHNPGGRERYEREFRDLAKAAGFSGFKATYIYANAWAIEFIK

SEQ ID NO: 426 - protein, 360 aa, Triticum aestivum
  misc_feature (1)..(360): Public GI ID no.30385246
  misc_feature (1)..(360): Bit score of 929.1 for HMM based on sequences of FIGURE 19.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 929.1 for HMM based on sequences of FIGURE 19.
  misc_feature (1)..(360): Functional Homolog Of Ceres ANNOT ID no. 1520476 at SEQ ID NO. 342
MGSTAADMAASADEEACMYALQLVSSSILPMTLKNAIELGLLETLVAAGGKLLTPAEVAAKLPSTANPAAADMVDRMLRLLASYNVVSCTMEEGKDGRLSRRYRAAPVCKFLTPNEDGVSMAALALMNQDKVLMESWYYLKDAVLDGGIPFNKAYGMSAFEYHGTDPRFNRVFNEGMKNHSIIITKKLLEVYKGFEGLGTIVDVGGGVGATVGAITAAYPAIKGINFDLPHVISEAQPFPGVTHVGGDMFQKVPSGDAILMKWILHDWSDEHCATLLKNCYDALPAHGKVVLVECILPVNPEATPKAQGVFHVDMIMLAHNPGGRERYEREFEALAKGAGFKAIKTTYIYANAFAIEFTK

SEQ ID NO: 427 - protein, 356 aa, Triticum aestivum
  misc_feature (1)..(356): Public GI ID no.77818928
  misc_feature (1)..(356): Bit score of 938.1 for HMM based on sequences of FIGURE 19.
  misc_feature (27)..(78): Pfam Name: Dimerisation Pfam Description: Dimerisation domain
  misc_feature (87)..(333): Pfam Name: Methyltransf_2 Pfam Description: O-methyltransferase
  misc_feature (87)..(333): Pfam Name: Methyltransf_2 Pfam Description: O-methyltransferase
  misc_feature (1)..(356): Bit score of 938.1 for HMM based on sequences of FIGURE 19.
  misc_feature (1)..(356): Functional Homolog Of Ceres ANNOT ID no. 1520476 at SEQ ID NO. 342
MGSIAAGADEDACMYALQLVSSSILPMTLKNAIELGLLETLMAAGGKFLTPAEVAAKLPSAANPEAPDMVDRMLRLLASYNVVSCRTEDGKDGRLSRRYGAAPVCKYLTPNEDGVSMSALALMNQDKVLMESWYYLKDAVLDGGIPFNKAYGMSAFEYHGTDPRFNRVFNEGMKNHSIIITKKLLESYKGFEGLGTLVDVGGGVGATVAAITAHYPTIKGINFDLPHVISEAPPFPGVTHVGGDMFQKVPSGDAILMKWILHDWSDEHCATLLKNCYDALPAHGKVVLVECILPVNPEATPKAQGVFHVDMIMLAHNPGGRERYEREFEALAKGAGFAAMKTTYIYANAWAIEFTK

SEQ ID NO: 428 - protein, 353 aa, Triticum aestivum
  misc_feature (1)..(353): Public GI ID no.145693798
  misc_feature (1)..(353): Bit score of 908.7 for HMM based on sequences of FIGURE 19.
  misc_feature (24)..(75): Pfam Name: Dimerisation Pfam Description: Dimerisation domain
  misc_feature (85)..(330): Pfam Name: Methyltransf_2 Pfam Description: O-methyltransferase
  misc_feature (85)..(330): Pfam Name: Methyltransf_2 Pfam Description: O-methyltransferase
  misc_feature (1)..(353): Bit score of 908.7 for HMM based on sequences of FIGURE 19.
  misc_feature (1)..(353): Functional Homolog Of Ceres ANNOT ID no. 1520476 at SEQ ID NO. 342
MGSTADEEACMFALQLGSSSILPMTLKNAIELGLLDTLVAADGKLLSPAELAAKLPSTANPAAPDMVDRMLRLLASYKVVSCTLEEDKDGRLSRRYGAEPVCKFLTPNEEGVSMAPLALMNQDKVLMESWYYLKDAVLDGGIPFNKAYGMSAFEYHGTDPRFNRVFNEGMKNHSIIITKKLLELYKGFNGVGTLVDVGGGIGATVGAITAHYPTIKGINFDLSHVISEAPPFPGVTHVGGDMFQKIPSGDTILMKWILHDWSDEHCATLLKNCYDALPTHGKVMLVECILPVNPEATPKAQGGFHLDMIMLAHNPGGKERYEREFEALAKGAGFGAMKTTYIYANTWVIEFTK

SEQ ID NO: 429 - protein, 360 aa, Triticum aestivum
  misc_feature (1)..(360): Public GI ID no.145693796
  misc_feature (1)..(360): Bit score of 897.2 for HMM based on sequences of FIGURE 19.
  misc_feature (31)..(82): Pfam Name: Dimerisation Pfam Description: Dimerisation domain
  misc_feature (92)..(337): Pfam Name: Methyltransf_2 Pfam Description: O-methyltransferase
  misc_feature (92)..(337): Pfam Name: Methyltransf_2 Pfam Description: O-methyltransferase
  misc_feature (1)..(360): Bit score of 897.2 for HMM based on sequences of FIGURE 19.
  misc_feature (1)..(360): Functional Homolog Of Ceres ANNOT ID no. 1520476 at SEQ ID NO. 342
MGSTATDIAASAHEEACMFALQLGSSSILPMTLKNSIELGLLDTLVAADGKLLSPAELAAKLPSTANPAAPDMVDRMLRLLASYKVVSCTLEEDKDGRLSRRYGAEPVCKFLTPNEEGVSMAPLALMNQDKVLMESWYYLKDAVLDGGSPFNKAHGMSAFEYHGTDPRFNCVFNEGMKNHSIIITKKLLELYKGFNGLDTLVDVGGGIGATVGAITAHYPTVKGINFDLPHVISEAPPFSGVTHVGGDMFQKIPSGDTILMKWILHDWSDEHCATLLKNCYDALPAHGKVVLVECILPVNPEATPEAQGGFHLDMIMLAHNPGGKERYEREFEALAKGAGFGAIKTTYIYANIWVIEFTK

SEQ ID NO: 430 - protein, 364 aa, Zea mays
  misc_feature (1)..(364): Public GI ID no.729135
  misc_feature (1)..(364): Bit score of 925.9 for HMM based on sequences of FIGURE 19.
  misc_feature (31)..(87): Pfam Name: Dimerisation Pfam Description: Dimerisation domain
  misc_feature (96)..(341): Pfam Name: Methyltransf_2 Pfam Description: O-methyltransferase
  misc_feature (96)..(341): Pfam Name: Methyltransf_2 Pfam Description: O-methyltransferase
  misc_feature (1)..(364): Bit score of 925.9 for HMM based on sequences of FIGURE 19.
  misc_feature (1)..(364): Functional Homolog Of Ceres ANNOT ID no. 1520476 at SEQ ID NO. 342
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDARFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWAIEFIK

SEQ ID NO: 431 - protein, 364 aa, Zea mays
  misc_feature (1)..(364): Public GI ID no.33641710
  misc_feature (1)..(364): Bit score of 923.8 for HMM based on sequences of FIGURE 19.
  misc_feature (31)..(87): Pfam Name: Dimerisation Pfam Description: Dimerisation domain
  misc_feature (96)..(341): Pfam Name: Methyltransf_2 Pfam Description: O-methyltransferase
  misc_feature (96)..(341): Pfam Name: Methyltransf_2 Pfam Description: O-methyltransferase
  misc_feature (1)..(364): Bit score of 923.8 for HMM based on sequences of FIGURE 19.
  misc_feature (1)..(364): Functional Homolog Of Ceres ANNOT ID no. 1520476 at SEQ ID NO. 342
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDSRFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWAIEFIK

SEQ ID NO: 432 - protein, 364 aa, Zea mays
  misc_feature (1)..(364): Public GI ID no.33641704
  misc_feature (1)..(364): Bit score of 928.6 for HMM based on sequences of FIGURE 19.
  misc_feature (31)..(87): Pfam Name: Dimerisation Pfam Description: Dimerisation domain
  misc_feature (96)..(341): Pfam Name: Methyltransf_2 Pfam Description: O-methyltransferase
  misc_feature (96)..(341): Pfam Name: Methyltransf_2 Pfam Description: O-methyltransferase
  misc_feature (1)..(364): Bit score of 928.6 for HMM based on sequences of FIGURE 19.
  misc_feature (1)..(364): Functional Homolog Of Ceres ANNOT ID no. 1520476 at SEQ ID NO. 342
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDPRFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWAIEFIK

SEQ ID NO: 433 - protein, 364 aa, Zea mays
  misc_feature (1)..(364): Public GI ID no.33641706
  misc_feature (1)..(364): Bit score of 917.4 for HMM based on sequences of FIGURE 19.
  misc_feature (31)..(87): Pfam Name: Dimerisation Pfam Description: Dimerisation domain
  misc_feature (96)..(341): Pfam Name: Methyltransf_2 Pfam Description: O-methyltransferase
  misc_feature (96)..(341): Pfam Name: Methyltransf_2 Pfam Description: O-methyltransferase
  misc_feature (1)..(364): Bit score of 917.4 for HMM based on sequences of FIGURE 19.
  misc_feature (1)..(364): Functional Homolog Of Ceres ANNOT ID no. 1520476 at SEQ ID NO. 342
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDPRFNRVFDEGMKNHSVIIAKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWAIEFIK

SEQ ID NO: 434 - protein, 364 aa, Zea mays
  misc_feature (1)..(364): Public GI ID no.33641708
  misc_feature (1)..(364): Bit score of 921.2 for HMM based on sequences of FIGURE 19.
  misc_feature (31)..(87): Pfam Name: Dimerisation Pfam Description: Dimerisation domain
  misc_feature (96)..(341): Pfam Name: Methyltransf_2 Pfam Description: O-methyltransferase
  misc_feature (96)..(341): Pfam Name: Methyltransf_2 Pfam Description: O-methyltransferase
  misc_feature (1)..(364): Bit score of 921.2 for HMM based on sequences of FIGURE 19.
  misc_feature (1)..(364): Functional Homolog Of Ceres ANNOT ID no. 1520476 at SEQ ID NO. 342
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDPRFNRVFNEGMKDHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKAIVVECVLPVNTEATPKAQGVFHVDMIMLAHNPGGKERYEREFRELAKGAGFSGFKATYIYANAWAIEFIK

SEQ ID NO: 435 - protein, 359 aa, Zea mays
  misc_feature (1)..(359): Public GI ID no.33641718
  misc_feature (1)..(359): Bit score of 900.9 for HMM based on sequences of FIGURE 19.
  misc_feature (31)..(87): Pfam Name: Dimerisation Pfam Description: Dimerisation domain
  misc_feature (96)..(341): Pfam Name: Methyltransf_2 Pfam Description: O-methyltransferase
  misc_feature (96)..(341): Pfam Name: Methyltransf_2 Pfam Description: O-methyltransferase
  misc_feature (1)..(359): Bit score of 900.9 for HMM based on sequences of FIGURE 19.
  misc_feature (1)..(359): Functional Homolog Of Ceres ANNOT ID no. 1520476 at SEQ ID NO. 342
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDARFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWA

SEQ ID NO: 436 - protein, 358 aa, Zea mays
  misc_feature (1)..(358): Public GI ID no.33641726
  misc_feature (1)..(358): Bit score of 895.8 for HMM based on sequences of FIGURE 19.
  misc_feature (31)..(87): Pfam Name: Dimerisation Pfam Description: Dimerisation domain
  misc_feature (96)..(341): Pfam Name: Methyltransf_2 Pfam Description: O-methyltransferase
  misc_feature (96)..(341): Pfam Name: Methyltransf_2 Pfam Description: O-methyltransferase
  misc_feature (1)..(358): Bit score of 895.8 for HMM based on sequences of FIGURE 19.
  misc_feature (1)..(358): Functional Homolog Of Ceres ANNOT ID no. 1520476 at SEQ ID NO. 342
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDARFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAW

SEQ ID NO: 437 - protein, 359 aa, Zea mays
  misc_feature (1)..(359): Public GI ID no.33641752
  misc_feature (1)..(359): Bit score of 896.1 for HMM based on sequences of FIGURE 19.
  misc_feature (31)..(87): Pfam Name: Dimerisation Pfam Description: Dimerisation domain
  misc_feature (96)..(341): Pfam Name: Methyltransf_2 Pfam Description: O-methyltransferase
  misc_feature (96)..(341): Pfam Name: Methyltransf_2 Pfam Description: O-methyltransferase
  misc_feature (1)..(359): Bit score of 896.1 for HMM based on sequences of FIGURE 19.
  misc_feature (1)..(359): Functional Homolog Of Ceres ANNOT ID no. 1520476 at SEQ ID NO. 342
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDARFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWG

SEQ ID NO: 438 - protein, 359 aa, Zea mays
  misc_feature (1)..(359): Public GI ID no.33641714
  misc_feature (1)..(359): Bit score of 900.1 for HMM based on sequences of FIGURE 19.
  misc_feature (31)..(87): Pfam Name: Dimerisation Pfam Description: Dimerisation domain
  misc_feature (96)..(341): Pfam Name: Methyltransf_2 Pfam Description: O-methyltransferase
  misc_feature (96)..(341): Pfam Name: Methyltransf_2 Pfam Description: O-methyltransferase
  misc_feature (1)..(359): Bit score of 900.1 for HMM based on sequences of FIGURE 19.
  misc_feature (1)..(359): Functional Homolog Of Ceres ANNOT ID no. 1520476 at SEQ ID NO. 342
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDARFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWA

SEQ ID NO: 439 - protein, 358 aa, Zea mays
  misc_feature (1)..(358): Public GI ID no.33641732
  misc_feature (1)..(358): Bit score of 893.7 for HMM based on sequences of FIGURE 19.
  misc_feature (31)..(87): Pfam Name: Dimerisation Pfam Description: Dimerisation domain
  misc_feature (96)..(341): Pfam Name: Methyltransf_2 Pfam Description: O-methyltransferase
  misc_feature (96)..(341): Pfam Name: Methyltransf_2 Pfam Description: O-methyltransferase
  misc_feature (1)..(358): Bit score of 893.7 for HMM based on sequences of FIGURE 19.
  misc_feature (1)..(358): Functional Homolog Of Ceres ANNOT ID no. 1520476 at SEQ ID NO. 342
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDSRFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAW

SEQ ID NO: 440 - protein, 359 aa, Zea mays
  misc_feature (1)..(359): Public GI ID no.33641716
  misc_feature (1)..(359): Bit score of 898.8 for HMM based on sequences of FIGURE 19.
  misc_feature (31)..(87): Pfam Name: Dimerisation Pfam Description: Dimerisation domain
  misc_feature (96)..(341): Pfam Name: Methyltransf_2 Pfam Description: O-methyltransferase
  misc_feature (96)..(341): Pfam Name: Methyltransf_2 Pfam Description: O-methyltransferase
  misc_feature (1)..(359): Bit score of 898.8 for HMM based on sequences of FIGURE 19.
  misc_feature (1)..(359): Functional Homolog Of Ceres ANNOT ID no. 1520476 at SEQ ID NO. 342
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDSRFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWA

SEQ ID NO: 441 - protein, 358 aa, Zea mays
  misc_feature (1)..(358): Public GI ID no.33641720
  misc_feature (1)..(358): Bit score of 898.5 for HMM based on sequences of FIGURE 19.
  misc_feature (31)..(87): Pfam Name: Dimerisation Pfam Description: Dimerisation domain
  misc_feature (96)..(341): Pfam Name: Methyltransf_2 Pfam Description: O-methyltransferase
  misc_feature (96)..(341): Pfam Name: Methyltransf_2 Pfam Description: O-methyltransferase
  misc_feature (1)..(358): Bit score of 898.5 for HMM based on sequences of FIGURE 19.
  misc_feature (1)..(358): Functional Homolog Of Ceres ANNOT ID no. 1520476 at SEQ ID NO. 342
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDPRFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAW

SEQ ID NO: 442 - protein, 358 aa, Zea mays
  misc_feature (1)..(358): Public GI ID no.33641740
  misc_feature (1)..(358): Bit score of 890.2 for HMM based on sequences of FIGURE 19.
  misc_feature (31)..(87): Pfam Name: Dimerisation Pfam Description: Dimerisation domain
  misc_feature (96)..(341): Pfam Name: Methyltransf_2 Pfam Description: O-methyltransferase
  misc_feature (96)..(341): Pfam Name: Methyltransf_2 Pfam Description: O-methyltransferase
  misc_feature (1)..(358): Bit score of 890.2 for HMM based on sequences of FIGURE 19.
  misc_feature (1)..(358): Functional Homolog Of Ceres ANNOT ID no. 1520476 at SEQ ID NO. 342
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDPRFNRVFNEGMKDHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKAIVVECVLPVNTEATPKAQGVFHVDMIMLAHNPGGKERYEREFRELAKGAGFSGFKATYIYANAW

SEQ ID NO: 443 - protein, 360 aa, Festuca arundinacea
  misc_feature (1)..(360): Public GI ID no.14578613
  misc_feature (1)..(360): Bit score of 932.3 for HMM based on sequences of FIGURE 19.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 932.3 for HMM based on sequences of FIGURE 19.
  misc_feature (1)..(360): Functional Homolog Of Ceres ANNOT ID no. 1520476 at SEQ ID NO. 342
MGSTAADMAASADEEACMFALQLASSSILPMTLKNAIELGLLEILVAAGGKSLTPTEVAAKLPSAANPEAPDMVDRMLRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFQGLGTLVDVGGGVGATVAAIAAHYPAIKGVNFDLPHVISEAPQFPGVTHVGGDMFKEVPSGDAILMKWILHDWSDQHCATLLKNCYDALPAHGKVVLVECILPVNPEAKPSSQGVFHVDMIMLAHNPGGRERYEREFEALARGAGFTGVKSTYIYANAWAIEFTK

SEQ ID NO: 444 - protein, 360 aa, Festuca arundinacea
  misc_feature (1)..(360): Public GI ID no.14578611
  misc_feature (1)..(360): Bit score of 935.3 for HMM based on sequences of FIGURE 19.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 935.3 for HMM based on sequences of FIGURE 19.
  misc_feature (1)..(360): Functional Homolog Of Ceres ANNOT ID no. 1520476 at SEQ ID NO. 342
MGSTAADMAASADEDACMFALQLASSSVLPMTLKNAIELGLLEILVAAGGKSLTPTEVAAKLPSAANPEAPDMVDRILRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFEGLGSLVDVGGGVGATVAAIAAHYPTIKGVNFDLPHVISEAPQFPGVTHVGGDMFKEVPSGDAILMKWILHDWSDQHCATLLKNCYDALPAHGKVVLVECILPVNPEANPSSQGVFHVDMIMLAHNPGGRERYEREFQALARGAGFTGVKSTYIYANAWAIEFTK

SEQ ID NO: 445 - protein, 360 aa, Festuca arundinacea
  misc_feature (1)..(360): Public GI ID no.14578615
  misc_feature (1)..(360): Bit score of 935.1 for HMM based on sequences of FIGURE 19.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 935.1 for HMM based on sequences of FIGURE 19.
  misc_feature (1)..(360): Functional Homolog Of Ceres ANNOT ID no. 1520476 at SEQ ID NO. 342
MGSTAADMAASADEEACMFALQLASSSILPMTLKNAIELGLLEILVAAGGKSLTPTEVAAKLPSAANPEAPDMVDRMLRLLASYNVVSCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFQGLGTLVDVGGGVGATVAAITAHYPAIKGVNFDLPHVISEAPPFPGVTHVGGDMFKEVPSGDAILMKWILHDWSDQHCATLLKNCYDALPAHGKVVLVECILPVNPEAKPSSQGVFHVDMIMLAHNPGGRERYEREFEALARGAGFTGVKSTYIYANAWAIEFTK

SEQ ID NO: 446 - protein, 360 aa, Festuca arundinacea
  misc_feature (1)..(360): Public GI ID no.14578617
  misc_feature (1)..(360): Bit score of 918.4 for HMM based on sequences of FIGURE 19.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 918.4 for HMM based on sequences of FIGURE 19.
  misc_feature (1)..(360): Functional Homolog Of Ceres ANNOT ID no. 1520476 at SEQ ID NO. 342
MGSSAADVAASADEEACMYALQLGSSSILPMTLKNTIELGLLETLMAAGGKSLTPTEVAAKLPCAANPEAPDMVDRMLRLLASYNVVSCLVEEGTDGRLSRRYGAAPVCKFLTPNEDGVSMAALALMNQDKVLMESWYYLKDAVLDGGIPFNKAYGMSAFEYHGTDPRFNRVFNEAMKNNSIIITKKLLELYDGFQGIGTLVDVGGSVGATVAAITAHYPAIEGINFDLPHVISEAPPFPGVTHVGGDMFKKVPSGDAILMKWILHDWSDQHCATLLKNCYDALPAHGKVVLVECILPVHPEAKPSSQGVFHVDMIMLAHNPGGRERYEREFEALAKGAGFAGFKSTYIYANAWAIEFTK

SEQ ID NO: 447 - protein, 358 aa, Gossypium arboreum
  misc_feature (1)..(358): Public GI ID no.133902310
  misc_feature (1)..(358): Bit score of 885.8 for HMM based on sequences of FIGURE 19.
  misc_feature (25)..(76): Pfam Name: Dimerisation Pfam Description: Dimerisation domain
  misc_feature (87)..(331): Pfam Name: Methyltransf_2 Pfam Description: O-methyltransferase
  misc_feature (87)..(331): Pfam Name: Methyltransf_2 Pfam Description: O-methyltransferase
  misc_feature (1)..(358): Bit score of 885.8 for HMM based on sequences of FIGURE 19.
  misc_feature (1)..(358): Functional Homolog Of Ceres ANNOT ID no. 1520476 at SEQ ID NO. 342
MSQEDQEEEVGKLAVRLANAVVLPMVLKSALELNIIDTILAAGDGAFLSPSQIASALPSKNPDAPVLLDRMLRLLASHSILKCSVKAKEKEEIERLYGAGPLCKFLVKNQDGGSIAPLLLLHHDQVFMQSWYHLNDAILEGGVPFSKAYGMTAFEYPGTDQRFNRVFNQAMSNHTALIMRKIVDVYKGFDGLKVLVDVGGGIGVALSFITSKYPQIKGINFDLPHVLADAPTYLGVEHVGGDMFESVPKGDAIFLKWILHDWSDEHCLKLLKNCWEALPNGGKVIIVESILPEVPDTSVSSNIVCEQDLFMLAQNPGGKERTLKEYEDLALKTGFSGCEVICCAYNSWVMQMEKRAIY

SEQ ID NO: 448 - protein, 358 aa, Gossypium raimondii
  misc_feature (1)..(358): Public GI ID no.133902303
  misc_feature (1)..(358): Bit score of 890.3 for HMM based on sequences of FIGURE 19.
  misc_feature (25)..(76): Pfam Name: Dimerisation Pfam Description: Dimerisation domain
  misc_feature (86)..(331): Pfam Name: Methyltransf_2 Pfam Description: O-methyltransferase
  misc_feature (86)..(331): Pfam Name: Methyltransf_2 Pfam Description: O-methyltransferase
  misc_feature (1)..(358): Bit score of 890.3 for HMM based on sequences of FIGURE 19.
  misc_feature (1)..(358): Functional Homolog Of Ceres ANNOT ID no. 1520476 at SEQ ID NO. 342
MSQEDQEEEVGKLAVRLANAVVLPMVLKSALELNIIDTISAAGDGAFLSPSQIASALPSKNPDAPVLLDRMLRLLASHSILKCSVKAKEKGEIERLYGAGPLCKFLVKNQDGGSIAPLLLLHHDQVFMQSWYHLNDAILEGGVPFSKAYGMTAFEYPGTDQRFNRVFNQAMSNHTALIMRKIVDVYKGFDGLKVLVDVGGGIGVALSFITSKYPQIKGINFDLPHVLADAPTYSGVEHVGGDMFESVPKGDAIFLKWILHDWSDEHCLKLVKNCWEALPNGGKVIIVESILPEVPDTSVSSNIVCEQDLFMLAQNPGGKERTLKEYEALALKTGFSGCEVICCAYNSWVMQMEKRAIY

SEQ ID NO: 449 - protein, 386 aa, Vitis vinifera
  misc_feature (1)..(386): Public GI ID no.7271883
  misc_feature (1)..(386): Bit score of 959.0 for HMM based on sequences of FIGURE 19.
  misc_feature (114)..(361): Pfam Name: Methyltransf_2 Pfam Description: O-methyltransferase
  misc_feature (114)..(361): Pfam Name: Methyltransf_2 Pfam Description: O-methyltransferase
  misc_feature (54)..(105): Pfam Name: Dimerisation Pfam Description: Dimerisation domain
  misc_feature (1)..(386): Bit score of 959 for HMM based on sequences of FIGURE 19.
  misc_feature (1)..(386): Functional Homolog Of Ceres ANNOT ID no. 1520476 at SEQ ID NO. 342
MESTLAFNSGSNSMNQSFSSSAEFNSPVPETIPKSEEDTFVFATLLTSASVLPMALKSALELDLLEIIAKAGPGAFVSTSEIAAKITKRNPKAPVMLDRILRLLATYDVVKCSLRDSPDGGVERLYGLGPVCKYFTTNEDGVSVAPLLLMNQDKVPMQSKRYHLKDAVLDGGIPFNKAYGMTDFEYHGTEPRFNKVFNNGVSGHPTITMKKILEAYKGFEGLTSIVDVGGGTGATLNMIISKYPTIKGINFDLPHVIDDAPSYPGVEHVGGDMFVSVPKGDAIFMKWMCYEWDDAHCLKFLENCYQALPDNGKVIVAECILPVVPDTSLATKSAVHIDVIMLAYNTGGKARTEKEFEALAKGAGFQGFKVVCCAFNSWIMEFCKTA

SEQ ID NO: 450 - protein, 354 aa, Zinnia elegans
  misc_feature (1)..(354): Public GI ID no.29839290
  misc_feature (1)..(354): Bit score of 964.0 for HMM based on sequences of FIGURE 19.
  misc_feature (24)..(76): Pfam Name: Dimerisation Pfam Description: Dimerisation domain
  misc_feature (84)..(331): Pfam Name: Methyltransf_2 Pfam Description: O-methyltransferase
  misc_feature (84)..(331): Pfam Name: Methyltransf_2 Pfam Description: O-methyltransferase
  misc_feature (1)..(354): Bit score of 964 for HMM based on sequences of FIGURE 19.
  misc_feature (1)..(354): Functional Homolog Of Ceres ANNOT ID no. 1520476 at SEQ ID NO. 342
MGSNQDDQAFLFAMQLASASVLPMVLKTAIELDLLETIAKAGPHGSVSSSELVAQLPKVNNPEAPVMIDRICSLLASYSVLTCTLKETADGCAERFYGLAPVCKFLIKNDAGVSLAPLLLMNQDKVLMESWYYLKDPVLDGGIPFNKAYGMSAFEYHGKDQRFNKVFNSGMFNHSTMTMKKIVELYNGFSGLKTLVDVGGGTGASLNMITSKHKSLKGINFDLPHVIADATTYQGIEHVGGDMFESVPKGDAIFMKWILHDWSDAHCLQVLKNCYKSLPENGKVIVAECILPEAPDTTPATQNVIHIDVIMLAHNPGGKERTEKEFEALAKGAGFKGFNKAACALNTWVMEFCK

SEQ ID NO: 451 - protein, 364 aa, Mentha x piperita
  misc_feature (1)..(364): Public GI ID no.38047397
  misc_feature (1)..(364): Bit score of 840.9 for HMM based on sequences of FIGURE 19.
  misc_feature (37)..(88): Pfam Name: Dimerisation Pfam Description: Dimerisation domain
  misc_feature (99)..(341): Pfam Name: Methyltransf_2 Pfam Description: O-methyltransferase
  misc_feature (1)..(364): Bit score of 840.9 for HMM based on sequences of FIGURE 19.
  misc_feature (1)..(364): Functional Homolog Of Ceres ANNOT ID no. 1520476 at SEQ ID NO. 342
MEASFENGRKRSSSSSSEEESAFSFAMELAAGSVLPMVIKSAIDLNLLELIKRGGEEGASAYELAAQINAENPKAAAEMIDRILQLLAAHSVLTCRVETPPSRRRRYSLAAVCKFLTRDEDGASLAPLSLLVQDRVFMEPWYHLKDVIVEGGVAFERAYGVHAFEYHAKDPKFNKIFNQAMHNQSIIFMKRILEIYKGFEGVKSLVDVGGGTGASSKMIVSKYPLIKAINFDLPHVIQDASPHPEVEHVGGDMFVSVPKADAIFLKWICHDWSDEHCRKLLKNCYDAILGNGKVIIAESTLPEDPNSGPDTIHAIRGDVIMLTVNPGGKERTEKEFRTLALQAGFKRLVKVCAAFHTCIMECHK

SEQ ID NO: 452 - protein, 365 aa, Populus sieboldii x Populus grandidentata
  misc_feature (1)..(365): Public GI ID no.29839288
  misc_feature (1)..(365): Bit score of 1058.8 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1058.8 for HMM based on sequences of FIGURE 19.
  misc_feature (1)..(365): Functional Homolog Of Ceres ANNOT ID no. 1520476 at SEQ ID NO. 342
MGSTGETQMTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILEGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPNADAVFMKWICHDWSDAHCLKFLKNCYDALPENGKVILVECILPVAPDTSLATKGVVHVDVIMLAHNPGGKERTEKEFEGLANGAGFQGFEVMCCAFNTHVIEFRKKA

SEQ ID NO: 453 - protein, 364 aa, Populus sieboldii x Populus grandidentata
  misc_feature (1)..(364): Public GI ID no.29839289
  misc_feature (1)..(364): Bit score of 993.5 for HMM based on sequences of FIGURE 19.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(364): Bit score of 993.5 for HMM based on sequences of FIGURE 19.
  misc_feature (1)..(364): Functional Homolog Of Ceres ANNOT ID no. 1520476 at SEQ ID NO. 342
MGSTGETQMSPAQILDEEANFAMQLISSSVLPMVLKTAIELDLLEIMAKAGPGALLSPSDIASHLPTKNPDAPVMLDRILRLLASYSILICSLRDLPDGKVERLYGLASVCKFLTKNEDGVSVSPLCLMNQDKVLMESWYHLKDAILEGGIPFNKAYGMTAFEYHGTDPRFNKVFNKGMSDHSKMAMKKILESYKGFEGLASLVDVGGGTGAVVSTIVSKYPSIKGINFDLPHVIADAPAFPGVENVGGDMFVSVPKADAVFMKWICHDWSDEHCLRLLKNCYDALPENGKVILVECILPVAPDTSLATKGVMHVDAIMLAHNPGGKERTDKEFEGLARGAGFKGFEVMCCAFNTHVIEFRKQA

SEQ ID NO: 454 - protein, 365 aa, Stylosanthes humilis
  misc_feature (1)..(365): Public GI ID no.1582580
  misc_feature (1)..(365): Bit score of 1036.0 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1036 for HMM based on sequences of FIGURE 19.
  misc_feature (1)..(365): Functional Homolog Of Ceres ANNOT ID no. 1520476 at SEQ ID NO. 342
MGSTGETQITPTVVSDEEANLFAMQLASASVLPMVLKSAIELDVLEIIAKAGPGVHLSPADIAANVPTTNPDAAVMLDRMLRLLACYNILNHSLRTLPDGKVERLYGLAPVAKFLVKNEDGVSLSALNLMNHDKVLMESWYYLKETVLEGGIPFNKAYGMTAFEYHGTDPRFNKVFNKGMNDHTTITMKKILEIYTGFEGLKSLVDVGGGVGAVVNMIVTKYPHIKGINFDLPHVIEDAPSYPGVEHVGGDMFVSVPKADAVFMKWICHDWSDEHCIKFLKNCYDAVPDNGKVIVAECILPVAPDSSLATKGVVHIDVIMLAHNPGGKERTEKEFEALAKAAGFQGFRVVCCAFNTYIMEFLKKP

SEQ ID NO: 455 - protein, 365 aa, Iris hollandica
  misc_feature (1)..(365): Public GI ID no.57157826
  misc_feature (1)..(365): Bit score of 886.8 for HMM based on sequences of FIGURE 19.
  misc_feature (35)..(86): Pfam Name: Dimerisation Pfam Description: Dimerisation domain
  misc_feature (96)..(342): Pfam Name: Methyltransf_2 Pfam Description: O-methyltransferase
  misc_feature (96)..(342): Pfam Name: Methyltransf_2 Pfam Description: O-methyltransferase
  misc_feature (1)..(365): Bit score of 886.8 for HMM based on sequences of FIGURE 19.
  misc_feature (1)..(365): Functional Homolog Of Ceres ANNOT ID no. 1520476 at SEQ ID NO. 342
MDSTPVIQIPTPYPFSDEEACLYAMQLRSFSVLPMTLKAAIELDLLEIIAKAGPGAYLSPAEISSQLPTENPEAPAMIDRMLRLLACYSVVSCRVDAAGDDGKPRRRYGAERVVKYLTKNEDGVSMAALTLMNQDKVFMESWYHLKDAVLEGGIPFKKAFGMSPFEYQGTDPRFNKVFNEGMRNHSAFIMKKILETYQGFDSVKLLVDVGGGLGGTMKAIVTKYPHIEGINFDLSHVISEAPPIPGVKHVGGDMFESVPSGDAIFMKWILHDWSDAHCLKLLSNCWKALPEDGKVIVMEGILPTIPEPTSAAQGVVHIDLVMMAHNPGGKERTKAEFESLARDAGFSGSKALCSYANCWILEFYK

SEQ ID NO: 456 - protein, 364 aa, Ipomoea nil
  misc_feature (1)..(364): Public GI ID no.97974173
  misc_feature (1)..(364): Bit score of 1057.1 for HMM based on sequences of FIGURE 19.
  misc_feature (35)..(86): Pfam Name: Dimerisation Pfam Description: Dimerisation domain
  misc_feature (95)..(341): Pfam Name: Methyltransf_2 Pfam Description: O-methyltransferase
  misc_feature (95)..(341): Pfam Name: Methyltransf_2 Pfam Description: O-methyltransferase
  misc_feature (1)..(364): Bit score of 1057.1 for HMM based on sequences of FIGURE 19.
  misc_feature (1)..(364): Functional Homolog Of Ceres ANNOT ID no. 1520476 at SEQ ID NO. 342
MGSTGNDSPMTNRVDSDEEASLFAMQLASASVLPMVLKSAIELDLLELIAKAGPGAAVSPSELAAQLPTTNPDAAVMLDRILRLLCTYSVLNCSLRTLPDGRVERLYSLAPVCKYLTKNGDGVSMAPLLLMNQDKVLMESWYHLKDAVLEGGIPFNKAYGMTAFEYHGTDPRFNKVFNRGMSDHSTITMKKILDDYKGFEGLKSLVDVGGGTGATLNMILSKYPNIKGINFDLPHVIEDSPKYPGIEHVGGDMFVSVPKGDAIFMKWICHDWSDAHCLKFLKNCYDALPENGKVIVAECNLPESPDTSLATKNVVHIDVIMLAHNPGGKERTEKEFEALAMGSGFRHFRKACCAVNTWIMEFCK

SEQ ID NO: 457 - protein, 364 aa, Ipomoea nil
  misc_feature (1)..(364): Public GI ID no.97974184
  misc_feature (1)..(364): Bit score of 1060.0 for HMM based on sequences of FIGURE 19.
  misc_feature (35)..(86): Pfam Name: Dimerisation Pfam Description: Dimerisation domain
  misc_feature (95)..(341): Pfam Name: Methyltransf_2 Pfam Description: O-methyltransferase
  misc_feature (95)..(341): Pfam Name: Methyltransf_2 Pfam Description: O-methyltransferase
  misc_feature (1)..(364): Bit score of 1060 for HMM based on sequences of FIGURE 19.
  misc_feature (1)..(364): Functional Homolog Of Ceres ANNOT ID no. 1520476 at SEQ ID NO. 342
MGSTGNDSPMTNRVDSDEEASLFAMQLASASVLPMVLKSAIELDLLELIAKAGPGAAVSPSELAAQLPTTNPDAAVMLDRILRLLCTYSVLNCSLRTLPDGRVERLYSLAPVCKYLTKNGDGVSMAPLLLMNQDKVLMESWYHLKDAVLEGGIPFNKAYGMTAFEYHGTDPRFNKVFNRGMSDHSTITMKKILDDYKGFEGLKSLVDVGGGTGATLNMILSKYPNIKGINFDLPHVIEDAPKYPGIEHVGGDMFVSVPKGDAIFMKWICHDWSDAHCLKFLKNCYDALPENGKVIVAECNLPESPDTSLATKNVVHIDVIMLAHNPGGKERTEKEFEALAMGSGFRHFRKACCAVNTWIMEFCK

SEQ ID NO: 458 - protein, 343 aa, Chrysosplenium americanum
  misc_feature (1)..(343): Public GI ID no.24212064
  misc_feature (1)..(343): Bit score of 947.4 for HMM based on sequences of FIGURE 19.
  misc_feature (15)..(64): Pfam Name: Dimerisation Pfam Description: Dimerisation domain
  misc_feature (75)..(316): Pfam Name: Methyltransf_2 Pfam Description: O-methyltransferase
  misc_feature (75)..(316): Pfam Name: Methyltransf_2 Pfam Description: O-methyltransferase
  misc_feature (1)..(343): Bit score of 947.4 for HMM based on sequences of FIGURE 19.
  misc_feature (1)..(343): Functional Homolog Of Ceres ANNOT ID no. 1520476 at SEQ ID NO. 342
MLFAMQLASASVLPMVLKSAIELDLLEIIRGQDTCMSPTEIASHLPTTNPDAPAMVDRILRLLSCYSVVTCSVRSVDDQRVYGLAPVCKYLTKNQDGVSIAALCLMNQDKVLMESWYHLKDAVLDGGIPFNKAYGMSSFEYHGTDPRFNKVFNRGMSDHSTITMKKVFQAYQGFQGLTSLVDVGGGTGATLTMILSKYPTIRCINFDLPHVIEDAPEYPGIEHVGGDMFVSVPKGDAIFMKWICHDWSDEHCLKLLKNCYDALPNNGKVILAECILPEVPDSSLATKGVVHIDVITVAHNPGGKERTEKEFEALAKAAGFQGFQVFCNAFNTYIIEFSKQICN

SEQ ID NO: 459 - protein, 343 aa, Chrysosplenium americanum
  misc_feature (1)..(343): Public GI ID no.24212067
  misc_feature (1)..(343): Bit score of 944.8 for HMM based on sequences of FIGURE 19.
  misc_feature (15)..(64): Pfam Name: Dimerisation Pfam Description: Dimerisation domain
  misc_feature (75)..(316): Pfam Name: Methyltransf_2 Pfam Description: O-methyltransferase
  misc_feature (75)..(316): Pfam Name: Methyltransf_2 Pfam Description: O-methyltransferase
  misc_feature (1)..(343): Bit score of 944.8 for HMM based on sequences of FIGURE 19.
  misc_feature (1)..(343): Functional Homolog Of Ceres ANNOT ID no. 1520476 at SEQ ID NO. 342
MLFAMQLACASVLPMVLKSAIELDLLEIIRGQDTCMSPTEIASHLPTTNPDAPAMVDRILRLLSCYSVVTCSVRSVDDQRVYGLAPVCKYLTKNQDGVSIAALCLMNQDKVLMESWYHLKDAVLDGGIPFNKAYGMSSFEYHGTDPRFNKVFNRGMSDHSTITMKKVFQTYQGFQGLTSLVDVGGGTGATLTMILSKYPTIRCINFDLPHVIEDAPEYPGIEHVGGDMFVSVPKGDAIFMKWICHDWSDEHCLKLLKNCYDALPNNGKVILAECILPEVPDSSLATKGVVHIDVITVAHNPGGKERTEKEFEALAKAAGFQGFQVFCNAFNTYIIEFSKKICN

SEQ ID NO: 460 - protein, 343 aa, Chrysosplenium americanum
  misc_feature (1)..(343): Public GI ID no.567077
  misc_feature (1)..(343): Bit score of 821.8 for HMM based on sequences of FIGURE 19.
  misc_feature (15)..(64): Pfam Name: Dimerisation Pfam Description: Dimerisation domain
  misc_feature (75)..(316): Pfam Name: Methyltransf_2 Pfam Description: O-methyltransferase
  misc_feature (1)..(343): Bit score of 821.8 for HMM based on sequences of FIGURE 19.
  misc_feature (1)..(343): Functional Homolog Of Ceres ANNOT ID no. 1520476 at SEQ ID NO. 342
MLFAMQLASASVLPMVLKSAIELDLLEIIASQDTCMSPTEIASHLPTTNPHAPTMIDRILRLLSSYSIVTCSVRSVDDQRVYSPAPVCKYLTKNQDGVSIAALCVAAQDKVLMECWYHMKDAVLDGGIPFNKAYGMPIFDYFAKDLGSNKVFNKGMSDFSSMIIKKILETYKGFQGLTSLVDVGGGTGATLTKILSKYPTIRGINFDLPHVIQDAPEYPGIEHVGGDMFVSVPKGDAIFMKWICHDWNEEQCLKLLKNCYDALPNNGKVIVAEYILPVVPDSSLASKLSVTADVMIVTQNSGGKERTEKEFEALAKAAGFQGFQVFCNAFTIYIIEFSKNISN

SEQ ID NO: 461 - protein, 358 aa, Medicago sativa subsp. x varia
  misc_feature (1)..(358): Public GI ID no.6688808
  misc_feature (1)..(358): Bit score of 625.6 for HMM based on sequences of FIGURE 19.
  misc_feature (40)..(81): Pfam Name: Dimerisation Pfam Description: Dimerisation domain
  misc_feature (89)..(335): Pfam Name: Methyltransf_2 Pfam Description: O-methyltransferase
  misc_feature (1)..(358): Bit score of 625.6 for HMM based on sequences of FIGURE 19.
  misc_feature (1)..(358): Functional Homolog Of Ceres ANNOT ID no. 1520476 at SEQ ID NO. 342
MENGKVHVVKPQSEARLAILELAHIMSVPTSLVAVLKMKVPEAIWQGGKNTPLSASQILSIVRPNGGGDAENLQRILRLLTTYAIFAEDLSSNGKRKYSLTDIGKALVPDDDGLSYATYVLQHYQDQYLRAWPLVGDAVEDASVEPFEKLHGEGAYAYCMKRPDEMSLFYASMSGLSMPHMNEMLEKYDGFKGVETLVDVGGNSGVILNMIMNKYPNILKGINFDLPDMISSAPQLPGITHVGGDALESVPAGDAIFTKWTMLTWTDEECKKVLQNCYKALPVNGKLIVCEPVSPELTDESQRTRALLSGDIFIMTMYRTKGKHRTEEQFKQLGISTGFLRFRAFHIDPYFPVLEFQK

SEQ ID NO: 462 - protein, 370 aa, Clarkia breweri
  misc_feature (1)..(370): Public GI ID no.3913289
  misc_feature (1)..(370): Bit score of 1036.1 for HMM based on sequences of FIGURE 19.
  misc_feature (36)..(90): Pfam Name: Dimerisation Pfam Description: Dimerisation domain
  misc_feature (99)..(345): Pfam Name: Methyltransf_2 Pfam Description: O-methyltransferase
  misc_feature (99)..(345): Pfam Name: Methyltransf_2 Pfam Description: O-methyltransferase
  misc_feature (1)..(370): Bit score of 1036.1 for HMM based on sequences of FIGURE 19.
  misc_feature (1)..(370): Functional Homolog Of Ceres ANNOT ID no. 1520476 at SEQ ID NO. 342
MGSTGNAETQLTPTHVSDEEANLFAMQLASASVLPMVLKAAIELDVLEIMAKSIPHGSGAYISPAEIAAQLPTTNPDAPVMLDRVLRLLASYSVVTCSLRELPDGKVERLYGLAPVCKFLTKNEDGVSLAPLCLMNQDKVLMESWYYLKDAILDGGIPFNKAYGMTAFEYHGTDPRFNKVFNRGMSDHSTITMKKIFEMYTGFEALNTIVDVGGGTGAVLSMIVAKYPSIKGINFDLPHVIEDAPIYPGVEHVGGDMFVSVPKGDAIFMKWICHDWSDEHCLKFLKNCYAALPEHGKVIVAECILPLSPDPSLATKGVIHIDAIMLAHNPGGKERTEKEFEALAIGAGFKGFKVACCAFNTYVMEFLKTA

SEQ ID NO: 463 - protein, 368 aa, Clarkia breweri
  misc_feature (1)..(368): Public GI ID no.38502831
  misc_feature (1)..(368): Bit score of 908.3 for HMM based on sequences of FIGURE 19.
  misc_feature (36)..(88): Pfam Name: Dimerisation Pfam Description: Dimerisation domain
  misc_feature (97)..(343): Pfam Name: Methyltransf_2 Pfam Description: O-methyltransferase
  misc_feature (97)..(343): Pfam Name: Methyltransf_2 Pfam Description: O-methyltransferase
  misc_feature (1)..(368): Bit score of 908.3 for HMM based on sequences of FIGURE 19.
  misc_feature (1)..(368): Functional Homolog Of Ceres ANNOT ID no. 1520476 at SEQ ID NO. 342
MGSTGNAEIQIIPTHSSDEEANLFAMQLASAAVLPMALKAAIELDVLEIMAKSVPPSGYISPAEIAAQLPTTNPEAPVMLDRVLRLLASYSVVTYTLRELPSGKVERLYGLAPVCKFLTKNEDGVSLAPFLLTATDKVLLEPWFYLKDAILEGGIPFNKAYGMNEFDYHGTDHRFNKVFNKGMSSNSTITMKKILEMYNGFEGLTTIVDVGGGTGAVASMIVAKYPSINAINFDLPHVIQDAPAFSGVEHLGGDMFDGVPKGDAIFIKWICHDWSDEHCLKLLKNCYAALPDHGKVIVAEYILPPSPDPSIATKVVIHTDALMLAYNPGGKERTEKEFQALAMASGFRGFKVASCAFNTYVMEFLKTA

SEQ ID NO: 464 - DNA, 1243 bp, Panicum virgatum
  misc_feature (1)..(1243): Ceres CLONE ID no.1917412
  misc_feature (1)..(1243): Encodes the peptide sequence at SEQ ID NO 465
ataccggctgtttccctccctctctctcaccaaatgtcgtcaccgccgccgccgccgccgccgcctccggccgaggcccgcctggccatgatggagctggccaacatgatctccgtcccgatggcgctcaccgccatcatccgcctgggcgttccctccgccgtctgggccggcggcgccaacgcccctctctccgccgccgagctcctcccggagggccacccggacccgtccgtcctggagcgcctcctccgcctgctagcctcccgcggcgtcttctcggagcacggcggctccccgcggcggttcgcgctcacggcggtggggcggaccctggtgccgggccccacgggcgcgtcctacgccgactacgtgctgcagcaccaccaggacgcgctggtggcggcctggccgcgcctccacgaggccgtgctcgaccccgccggccccgagcccttcgcgcgcgccaacgccggcgtgcccgcctacgcctactacggcaaggacagggaggccaatcaggtgatgctccgggccatgaccggcgtctccgagcccttcatggacgcgctgctcgacggctacgcccaaggcttccacggcgtggccacgctggtggacgtcgggggcagctccggggcctgcctccagatgatcatgcgcagggtcgccaccatcaccgagggcatcaacttcgacctgcccgacgtcgtcgccgcagcgccgcccatcgccggagtgcggcatgtgggtggagacatgttcaagtccatcccctccggcgacgccatattcatgaagtgggttctgacgacgtggaccaacgacgagtgcacggccatcctgaggaactgccacagcgcgctgccggccggcggcaaggtcatcgcctgcgagccggtggtgccggaagagacggacaccagcaccaggaccagggccctgctcgagaacgacatcttcgtcatgaccacctaccggacgcaggggagggagcgctccgaggacgagttccgccgcctcggcctcaccgccggcttcaccggattccgcgccatctacctcgacccattctatgccatcctcgagtacaacaagtgactcaacttgatccatcccttgtgttttcctttctttccactttaaattccttgtgacagttgagtcgaacagcatacttgtaataagaaataaggaatcatgctctttgaaccagagaaagtaaaaaaaaaaaaaaaaaaaa

SEQ ID NO: 465 - protein, 355 aa, Panicum virgatum
  misc_feature (1)..(355): Ceres CLONE ID no.1917412
  misc_feature (1)..(355): Bit score of 632.7 for HMM based on sequences of FIGURE 19.
  misc_feature (78)..(332): Pfam Name: Methyltransf_2 Pfam Description: O-methyltransferase
  misc_feature (1)..(355): Bit score of 632.7 for HMM based on sequences of FIGURE 19.
  misc_feature (1)..(355): Functional Homolog Of Ceres ANNOT ID no. 1520476 at SEQ ID NO. 342
MSSPPPPPPPPPAEARLAMMELANMISVPMALTAIIRLGVPSAVWAGGANAPLSAAELLPEGHPDPSVLERLLRLLASRGVFSEHGGSPRRFALTAVGRTLVPGPTGASYADYVLQHHQDALVAAWPRLHEAVLDPAGPEPFARANAGVPAYAYYGKDREANQVMLRAMTGVSEPFMDALLDGYAQGFHGVATLVDVGGSSGACLQMIMRRVATITEGINFDLPDVVAAAPPIAGVRHVGGDMFKSIPSGDAIFMKWVLTTWTNDECTAILRNCHSALPAGGKVIACEPVVPEETDTSTRTRALLENDIFVMTTYRTQGRERSEDEFRRLGLTAGFTGFRAIYLDPFYAILEYNK

SEQ ID NO: 466 - protein, 361 aa, Ocimum basilicum
  misc_feature (1)..(361): Public GI ID no.29839421
  misc_feature (1)..(361): Bit score of 1040.1 for HMM based on sequences of FIGURE 19.
  misc_feature (32)..(83): Pfam Name: Dimerisation Pfam Description: Dimerisation domain
  misc_feature (92)..(338): Pfam Name: Methyltransf_2 Pfam Description: O-methyltransferase
  misc_feature (92)..(338): Pfam Name: Methyltransf_2 Pfam Description: O-methyltransferase
  misc_feature (1)..(361): Bit score of 1040.1 for HMM based on sequences of FIGURE 19.
  misc_feature (1)..(361): Functional Homolog Of Ceres ANNOT ID no. 1520476 at SEQ ID NO. 342
MGSATNTPQINSDEEENFLFAMQLASASVLPMVLKSAIELDLLELIKKSGAGAFVSPVDLAAQLPTTNPDAHVMLDRILRLLTSYAILECRLKTLPDGGVERLYGLAPVCKFLTKNEDGVSMAPLTLMNQDKVLMESWYHLSDAVVDGGIPFNKAYGMTAFEYHGTDPRFNKVFNQGMSNHSTITMKKILETYTGFDGLKTVVDVGGGTGATLNMIVSKYPSIKGINFDLPHVIEDAPSYPGVEHVGGDMFVSVPKGDAIFMKWICHDWSDEHCVKFLKNCYDALPQNGKVILAECVLPEAPDTGLATKNVVHIDVIMLAHNPGGKERTEKEFQGLAKAAGFKQFNKACCAYNTWIMELLK

SEQ ID NO: 467 - protein, 361 aa, Ocimum basilicum
  misc_feature (1)..(361): Public GI ID no.29839420
  misc_feature (1)..(361): Bit score of 1025.2 for HMM based on sequences of FIGURE 19.
  misc_feature (32)..(83): Pfam Name: Dimerisation Pfam Description: Dimerisation domain
  misc_feature (92)..(338): Pfam Name: Methyltransf_2 Pfam Description: O-methyltransferase
  misc_feature (92)..(338): Pfam Name: Methyltransf_2 Pfam Description: O-methyltransferase
  misc_feature (1)..(361): Bit score of 1025.2 for HMM based on sequences of FIGURE 19.
  misc_feature (1)..(361): Functional Homolog Of Ceres ANNOT ID no. 1520476 at SEQ ID NO. 342
MSSTANNPQINSDEEENFLFAMQLASASVLPMVLKSAIELDLLELIKKAGAGAFVSPAELAAQLLTTNAEAHVMLDRILRLLTSYAILECRLKTLPDGGVQRLYGLAPVCKFLTKNEDGVSMAPLALMNQDKVLMESWYHLKDAVLDGGIPFNKAYGMTAFEYHGTDPRFNKVFNQGMSNHSTITMKKILETYTGFDGLKTVVDVGGGTGATLNMIISKYPSIKGINFDLPHVVEDAPSYPGVEHVGGDMFVSVPKGDAIFMKWICHDWSDAHCVKFLKKCYEALPENGKVILAECVLPEAPDTGLATKNVVHIDVIMLAHNPGGKERTEKEFQVLAKASGFKQFNKVCCAYNSWIMELLK

SEQ ID NO: 468 - protein, 361 aa, Oryza sativa subsp. indica
  misc_feature (1)..(361): Public GI ID no.125560205
  misc_feature (1)..(361): Bit score of 901.8 for HMM based on sequences of FIGURE 19.
  misc_feature (24)..(82): Pfam Name: Dimerisation Pfam Description: Dimerisation domain
  misc_feature (91)..(338): Pfam Name: Methyltransf_2 Pfam Description: O-methyltransferase
  misc_feature (91)..(338): Pfam Name: Methyltransf_2 Pfam Description: O-methyltransferase
  misc_feature (1)..(361): Bit score of 901.8 for HMM based on sequences of FIGURE 19.
  misc_feature (1)..(361): Functional Homolog Of Ceres ANNOT ID no. 1520476 at SEQ ID NO. 342
MAAAADEEACMYALQLASSSILPMTLKNAIELGLLETLQSAAVAGGGGKAALLTPAEVAEKLPSKANPAAADMVDRMLRLLASYNVVRCEMEEGADGKLSRRYAAAPVCKWLTPNEDGVSMAALALMNQDKVLMESWYYLKDAVLDGGIPFNKAYGMTAFEYHGTDARFNRVFNEGMKNHSVIITKKLLDLYTGFDAASTVVDVGGGVGATVAAVVSRHPHIRGINYDLPHVISEAPPFPGVEHVGGDMFASVPRSGDAILMKWILHDWSDEHCARLLKNCYDALPEHGKVVVVECVLPESSDATAREQGVFHVDMIMLAHNPGGKERYEREFRELARAAGFTGFKATYIYANAWAIEFTK

SEQ ID NO: 469 - protein, 368 aa, Oryza sativa subsp. japonica
  misc_feature (1)..(368): Public GI ID no.115474869
  misc_feature (1)..(368): Bit score of 916.0 for HMM based on sequences of FIGURE 19.
  misc_feature (31)..(89): Pfam Name: Dimerisation Pfam Description: Dimerisation domain
  misc_feature (98)..(345): Pfam Name: Methyltransf_2 Pfam Description: O-methyltransferase
  misc_feature (98)..(345): Pfam Name: Methyltransf_2 Pfam Description: O-methyltransferase
  misc_feature (1)..(368): Bit score of 916 for HMM based on sequences of FIGURE 19.
  misc_feature (1)..(368): Functional Homolog Of Ceres ANNOT ID no. 1520476 at SEQ ID NO. 342
MGSTAADMAAAADEEACMYALQLASSSILPMTLKNAIELGLLETLQSAAVAGGGGKAALLTPAEVADKLPSKANPAAADMVDRMLRLLASYNVVRCEMEEGADGKLSRRYAAAPVCKWLTPNEDGVSMAALALMNQDKVLMESWYYLKDAVLDGGIPFNKAYGMTAFEYHGTDARFNRVFNEGMKNHSVIITKKLLDLYTGFDAASTVVDVGGGVGATVAAVVSRHPHIRGINYDLPHVISEAPPFPGVEHVGGDMFASVPRGGDAILMKWILHDWSDEHCARLLKNCYDALPEHGKVVVVECVLPESSDATAREQGVFHVDMIMLAHNPGGKERYEREFRELARAAGFTGFKATYIYANAWAIEFTK

SEQ ID NO: 470 - protein, 361 aa, Oryza sativa subsp. japonica
  misc_feature (1)..(361): Public GI ID no.125602246
  misc_feature (1)..(361): Bit score of 901.9 for HMM based on sequences of FIGURE 19.
  misc_feature (24)..(82): Pfam Name: Dimerisation Pfam Description: Dimerisation domain
  misc_feature (91)..(338): Pfam Name: Methyltransf_2 Pfam Description: O-methyltransferase
  misc_feature (91)..(338): Pfam Name: Methyltransf_2 Pfam Description: O-methyltransferase
  misc_feature (1)..(361): Bit score of 901.9 for HMM based on sequences of FIGURE 19.
  misc_feature (1)..(361): Functional Homolog Of Ceres ANNOT ID no. 1520476 at SEQ ID NO. 342
MAAAADEEACMYALQLASSSILPMTLKNAIELGLLETLQSAAVAGGRGKAALLTPAEVADKLPSKANPAAADMVDRMLRLLASYNVVRCEMEEGADGKLSRRYAAAPVCKWLTPNEDGVSMAALALMNQDKVLMESWYYLKDAVLDGGIPFNKAYGMTAFEYHGTDARFNRVFNEGMKNHSVIITKKLLDLYTGFDAASTVVDVGGGVGATVAAVVSRHPHIRGINYDLPHVISEAPPFPGVEHVGGDMFASVPRGGDAILMKWILHDWSDEHCARLLKNCYDALPEHGKVVVVECVLPESSDATAREQGVFHVDMIMLAHNPGGKERYEREFRELARAAGFTGFKATYIYANAWAIEFTK

SEQ ID NO: 471 - protein, 367 aa, Glycyrrhiza echinata
  misc_feature (1)..(367): Public GI ID no.1669591
  misc_feature (1)..(367): Bit score of 719.1 for HMM based on sequences of FIGURE 19.
  misc_feature (102)..(343): Pfam Name: Methyltransf_2 Pfam Description: O-methyltransferase
  misc_feature (39)..(93): Pfam Name: Dimerisation Pfam Description: Dimerisation domain
  misc_feature (1)..(367): Bit score of 719.1 for HMM based on sequences of FIGURE 19.
  misc_feature (1)..(367): Functional Homolog Of Ceres ANNOT ID no. 1520476 at SEQ ID NO. 342
MSDSYSTKDNNLFSTSSEQTEDGACLSAMRLVTNLVYPAVLNAAIDLNLFEIIAKATPPGAFMSASEIASKLPLPTQHSDLPNRLDRMLRLLASYSVLTCATRSTERVYGLSQVGKYLVPDGSRGYLASFTTFLCYPALMNVWLNFKEAVVDEDIDLFKKLHGVSKYEYMETDPKMNHIFNKSMADVCATEMKRILQIYKGFEGISTLVDVGGGNGQNLKMIISKYPLIKGINFDLPQVIENAPPIPGIELVGGDMFASVPQGDAMILKAVCHNWSDEKCLEFLSNCHKALSPNGKVIVVEFILPEEPEPTEESQLASTLDNIMFITVGGRERTQKQYENMCKLAGFSKFQVACRAFSSLGVMEFYK

SEQ ID NO: 472 - protein, 365 aa, Ammi majus
  misc_feature (1)..(365): Public GI ID no.38565551
  misc_feature (1)..(365): Bit score of 1010.4 for HMM based on sequences of FIGURE 19.
  misc_feature (36)..(87): Pfam Name: Dimerisation Pfam Description: Dimerisation domain
  misc_feature (96)..(342): Pfam Name: Methyltransf_2 Pfam Description: O-methyltransferase
  misc_feature (96)..(342): Pfam Name: Methyltransf_2 Pfam Description: O-methyltransferase
  misc_feature (1)..(365): Bit score of 1010.4 for HMM based on sequences of FIGURE 19.
  misc_feature (1)..(365): Functional Homolog Of Ceres ANNOT ID no. 1520476 at SEQ ID NO. 342
MNTTTELIPPTFQVNDDEEEACMFAMQLASASVLPMVLKSAIELNLLESIAKAGPGAYVSPSQLAAALPSSQPDTPVMLDRILRLLASYSVLNCKLRDLPDARVERLYGLAPVCKFLTKNSDGVSMAPLLLMNQDKILMESWYHLKDAVLDGGIPFNKAYGMTAFEYHGKDPRFNKVFNQGMSNHSTITMKKILQTYDGFGGLKTVVDVGGGTGATLNMIISKYPNLKGINFDLPHVVEDAPSYAGVEHVGGDMFVSVPKGDAIFMKWICHDWSDAHCLAFLKNCYKALPKDGKVILAECILPEAPDSKLTTKNVILIDVIMLAHNPGGKERTEKEFEAFGKQAGFKSFNKACCAYNTWVIEYYK

SEQ ID NO: 473 - protein, 350 aa, Coffea canephora
  misc_feature (1)..(350): Public GI ID no.22652500
  misc_feature (1)..(350): Bit score of 1020.0 for HMM based on sequences of FIGURE 19.
  misc_feature (21)..(72): Pfam Name: Dimerisation Pfam Description: Dimerisation domain
  misc_feature (81)..(327): Pfam Name: Methyltransf_2 Pfam Description: O-methyltransferase
  misc_feature (81)..(327): Pfam Name: Methyltransf_2 Pfam Description: O-methyltransferase
  misc_feature (1)..(350): Bit score of 1020 for HMM based on sequences of FIGURE 19.
  misc_feature (1)..(350): Functional Homolog Of Ceres ANNOT ID no. 1520476 at SEQ ID NO. 342
MAEEEACLFAMSLASASVLPMVLKSAIELDLLELIAKAGPGAYVSPSELAAQLPTHNPEAPIMLDRILRLLATYSVLDCKLNNLADGGVERLYGLAPVCKFLTKNADGVSMAPLLLMNQDKVLMESWYHLKDAVLDGGIPFNKAYGMTAFEYHGTDPRFNKVFNQGMSNHSTITMKKILEVYRGFEGLKTVVDVGGGTGATLNMIISKYPTIKGINFELPHVVEDAPSHPGVEHVGGDMFVSVPKGDAIFMKWICHDWSDDHCRKLLRNCYQALPDNGKVILAECVLPEAPDTSLATQNVVHVDVVMLAHNPGGKERTEKEFEALAKGAGFKEFRKVCSAVNTWIMELCK

SEQ ID NO: 474 - protein, 350 aa, Coffea canephora
  misc_feature (1)..(350): Public GI ID no.29839361
  misc_feature (1)..(350): Bit score of 1018.7 for HMM based on sequences of FIGURE 19.
  misc_feature (21)..(72): Pfam Name: Dimerisation Pfam Description: Dimerisation domain
  misc_feature (81)..(327): Pfam Name: Methyltransf_2 Pfam Description: O-methyltransferase
  misc_feature (81)..(327): Pfam Name: Methyltransf_2 Pfam Description: O-methyltransferase
  misc_feature (1)..(350): Bit score of 1018.7 for HMM based on sequences of FIGURE 19.
  misc_feature (1)..(350): Functional Homolog Of Ceres ANNOT ID no. 1520476 at SEQ ID NO. 342
MAEEEACLFAMSLASASVLPMVLKSAIELDLLELIAKAGPGAYVSPSELAAQLPTHNPEAPIMLDRILRLLATYSVLDCKLNNLADGGVERLYGLAPVCKFLTKNADGVSMAPLLLMNQDKVLMESWYHLKDAVLDGGIPFNKAYGMTAFEYHGTDPRFNKVFNQGMSNHSTITMKKILEVYRGFEGLKTVVDVGGGTGATLNMIISKYPTIKGINFELPHVVEDAPSHSGVEHVGGDMFVSVPKGDAIFMKWICHDWSDDHCRKLLKNCYQALPDNGKVILAECVLPEAPDTSLATQNVVHVDVVMLAHNPGGKERTEKEFEALAKGAGFKEFRKVCSAVNTWIMELCK

SEQ ID NO: 475 - protein, 365 aa, Vanilla planifolia
  misc_feature (1)..(365): Public GI ID no.45444737
  misc_feature (1)..(365): Bit score of 894.1 for HMM based on sequences of FIGURE 19.
  misc_feature (36)..(87): Pfam Name: Dimerisation Pfam Description: Dimerisation domain
  misc_feature (97)..(342): Pfam Name: Methyltransf_2 Pfam Description: O-methyltransferase
  misc_feature (97)..(342): Pfam Name: Methyltransf_2 Pfam Description: O-methyltransferase
  misc_feature (1)..(365): Bit score of 894.1 for HMM based on sequences of FIGURE 19.
  misc_feature (1)..(365): Functional Homolog Of Ceres ANNOT ID no. 1520476 at SEQ ID NO. 342
MATWVEHQQQQNGSKDVDEEACMYAMQLSSMVVLPMTLRVAVELGILEQIQAGGPDSYLTAEDLAARLGNSNPLAPVMIERILRLLTSYSILNFTDTVDGEGRTVRSYGAAHVCKYLTPNQDGVSMAPLVLMNTDKVLMESWYHMKDAVTNGGIPFNLAYGMTAFEYHGKDLRFNKVFNEGMKNNSIIITKKILERYKRFEDVNVLIDVGGGIGGTISMITAKYPHIHGINFDLPHVVSEAPPFQGVEHVGGNMFESVPIGDAIFIKWILHDWSDEHCLKLLRNCAKSLPDKGKVIVVECILPDAPLVTPEAEGVFHLDMIMLAHNPGGKERTKKEFKELAMLSGFSNFKALFSYANVWVMEFNK

SEQ ID NO: 476 - protein, 365 aa, Acacia mangium x Acacia auriculiformis
  misc_feature (1)..(365): Public GI ID no.68159362
  misc_feature (1)..(365): Bit score of 1026.0 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1026 for HMM based on sequences of FIGURE 19.
  misc_feature (1)..(365): Functional Homolog Of Ceres ANNOT ID no. 1520476 at SEQ ID NO. 342
MGSAGETQITPTHVNDEEANLFAMQLASASVLPMILKSALELDLLEIIAKAGPNAQLSPSDIASQLPTKNPDAAVMLDRMMRLLACYNVLSSSLRTLPDGKIERLYGLAPVAKYLVKNEDGVSIAPLNLMNQDKVLMESWYYLTETVLEGGIPFNKAHGMTSFEYHGKDARFNKVFNKGMADHSTITMKKILETYTGFEGLKSLVDVGGGTGAVINTIVSKYPSIKGINFDLPHVIEEAPSFPGVEHVGGDMFVSVPKADAVFMKWICHDWSDEHCVKFLKNCYDALPENGKVIVAECILPVAPDSSLATKGVVHIDVIMLAHNPGGKERTEKEFEALAKGAGFQGFRVCCSAFNSYIMEFLKKP

SEQ ID NO: 477 - protein, 365 aa, Rosa chinensis
  misc_feature (1)..(365): Public GI ID no.29839344
  misc_feature (1)..(365): Bit score of 1057.4 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1057.4 for HMM based on sequences of FIGURE 19.
  misc_feature (1)..(365): Functional Homolog Of Ceres ANNOT ID no. 1520476 at SEQ ID NO. 342
MGSTGETQMTPTQVSDEEANLFAMQLASASVLPMVLKAAIELDLLEIMAKAGPGAFLSPNDLASQLPTKNPEAPVMLDRMLRLLASYSILTYSLRTLPDGKVERLYGLGPVCKFLTKNEDGVSIAALCLMNQDKVLVESWYHLKDAVLDGGIPFNKAYGMTAFDYHGTDPRFNKVFNKGMADHSTITMKKILETYKGFEGLTSIVDVGGGTGAVVNMIVSKYPSIKGINFDLPHVIEDAPQYPGVQHVGGDMFVSVPKGDAIFMKWICHDWSDEHCLKFLKNCYAALPDNGKVILGECILPVAPDTSLATKGVVHIDVVMLAHNPGGKERTEQEFEALAKGSGFQGIRVACNAFNTYVIEFLKKI

SEQ ID NO: 478 - protein, 362 aa, Thalictrum tuberosum
  misc_feature (1)..(362): Public GI ID no.4808530
  misc_feature (1)..(362): Bit score of 1004.7 for HMM based on sequences of FIGURE 19.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(362): Bit score of 1004.7 for HMM based on sequences of FIGURE 19.
  misc_feature (1)..(362): Functional Homolog Of Ceres ANNOT ID no. 1520476 at SEQ ID NO. 342
MGSTQNNHNLTPEEEEEACLHAMQLASASVLPMVLKAAIELDVLEIIAKAGQGAYVAPSEIASQLSTSNSQAPIILDRILRLLASYKVLTCNLRTLEDGGVERLYGLAPVCKFLVKNEDGVSMAPLVLMNQDKVLMESWYHLKDAVLDGGIPFNKAYGMTAFEYHGTDPRFNKVFNRGMSDHSTITMKKLLELYKGFEGLKSVVDVGGGTGATVNMIVTKHPTIKGINFDLPHVIEDAPAYPGVEHIGGDMFVCVPKGDAIFMKWILHDWSDEHSVKFLKNCYESIPADGKVIDVESILPVCPETNLAANACFQLDNIMLAHNPGGKERTEKDFEALSVKAGFTGFKVVCGAFGSWVMEFCK

SEQ ID NO: 479 - protein, 362 aa, Thalictrum tuberosum
  misc_feature (1)..(362): Public GI ID no.4808524
  misc_feature (1)..(362): Bit score of 992.8 for HMM based on sequences of FIGURE 19.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(362): Bit score of 992.8 for HMM based on sequences of FIGURE 19.
  misc_feature (1)..(362): Functional Homolog Of Ceres ANNOT ID no. 1520476 at SEQ ID NO. 342
MGSTQKNHNLTPEEEEEACLHAMQLASASVLPMVLKAAIELSVLEIIAKAGQGAYVAPTEIASQLSTSNSQAPIILDRILRLLASYKVLTCNLRTLEDGGVERLYGLAPVCKFLVKNEDGVSIAPLVLMNQDKVLMESWYHLKDAVLDGGIPFNKAYGMTAFEYHGTDPRFNKVFNRGMADHSTITMKKLLELYKGFEGLKSVVDVGGGTGATINMIVTKHPTIKGINFDLPHVIDDAPAYPGVEHIGGDMFVSVPKGDAIFMKWILHDWSDEHSVKFLKNCYESIPADGKVIIVESILPVYPETNLASNACFQLDNIMLAHNPGGKERTEKDFEALSAKAGFTGFKIVCGAFGSWVMEFCK

SEQ ID NO: 480 - protein, 364 aa, Thalictrum tuberosum
  misc_feature (1)..(364): Public GI ID no.4808522
  misc_feature (1)..(364): Bit score of 993.9 for HMM based on sequences of FIGURE 19.
  misc_feature (35)..(86): Pfam Name: Dimerisation Pfam Description: Dimerisation domain
  misc_feature (95)..(341): Pfam Name: Methyltransf_2 Pfam Description: O-methyltransferase
  misc_feature (95)..(341): Pfam Name: Methyltransf_2 Pfam Description: O-methyltransferase
  misc_feature (1)..(364): Bit score of 993.9 for HMM based on sequences of FIGURE 19.
  misc_feature (1)..(364): Functional Homolog Of Ceres ANNOT ID no. 1520476 at SEQ ID NO. 342
MGSTENNHNLTPAEEEEEEAYLHAMQLASASVLPMVLKAAIELDVLEIIAKAGKGAYVAPSEIASQLSTSNSQAPTVLDRMLRLLASYKVLTCNLRNLEDGGVERLYGLAPVCKFLVKNEDGVSMAPLVLMNQDKVLMESWYHLKDAVLDGGIPFNKAYGMTAFEYHGTDPRFNKVFNRGMADHSTITMKKLLELYKGFEGLKSVVDVGGGTGATVNMIVTKHPTIKGINFDLPHVIDDAPAYPGVEHIGGDMFVSVPKGDAIFMKWILHDWSDEHSVKFLKNCYESIPADGKVIIVESVLPVFPETNLAAHTCFQLDNIMLAHNPGGKERTEKDFKALSVKAGFTGFKVVCGAFGSWVMEFCK

SEQ ID NO: 481 - protein, 364 aa, Thalictrum tuberosum
  misc_feature (1)..(364): Public GI ID no.4808528
  misc_feature (1)..(364): Bit score of 998.5 for HMM based on sequences of FIGURE 19.
  misc_feature (35)..(86): Pfam Name: Dimerisation Pfam Description: Dimerisation domain
  misc_feature (95)..(341): Pfam Name: Methyltransf_2 Pfam Description: O-methyltransferase
  misc_feature (95)..(341): Pfam Name: Methyltransf_2 Pfam Description: O-methyltransferase
  misc_feature (1)..(364): Bit score of 998.5 for HMM based on sequences of FIGURE 19.
  misc_feature (1)..(364): Functional Homolog Of Ceres ANNOT ID no. 1520476 at SEQ ID NO. 342
MGSTENNHNLTPAEEEEEEACLHAMQLASASVLPMVLKAAIELDVLEIIAKAGKGAYVAPSEIASQLSTSNSQAPTVLDRMLRLLASYKVLTCNLRNLEDGGVERLYGLAPVCKFLVKNEDGVSMAPLVLMNQDKVLMESWYHLKDAVLDGGIPFNKAYGMTAFEYHGTDPRFNKVFNRGMADHSTITMKKLLELYKGFEGLKSVVDVGGGTGATVNMIVTKHPTIKGINFDLPHVIDDAPAYPGVEHIGGDMFVSVPKGDAIFMKWILHDWSDEHSVKFLKNCYESIPADGKVIIVESVLPVFPETNLAAHTCFQLDNIMLAHNPGGKERTEKDFKALSVKAGFTGFKVVCGAFGSWVMEFCK

SEQ ID NO: 482 - protein, 362 aa, Thalictrum tuberosum
  misc_feature (1)..(362): Public GI ID no.4808526
  misc_feature (1)..(362): Bit score of 989.4 for HMM based on sequences of FIGURE 19.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(362): Bit score of 989.4 for HMM based on sequences of FIGURE 19.
  misc_feature (1)..(362): Functional Homolog Of Ceres ANNOT ID no. 1520476 at SEQ ID NO. 342
MGSTQKNHNLTPEEEEEACLHAMQLASASVLPMVLKAAIELDVLEIIAKAGQGAYVAPTEIASQLSTSNSQAPIILDRVLRLLASYKVLTCNLRTLEDGGVERLYGLAPVCKFLVKNEDGVSIAPLVLMNQDKVLMESWYHLKDAVLDGGIPFNKAYGMTAFEYHGTDPRFNKVFNRGMADHSTITMKKLLELYKGFEGLKSVVDVGGGTGATINMIVTKHPTIKGINFYLPHVIDDAPAYPGVEHIGGDMFVSVPKGDAIFMKWILHDWSDEHSVKFLKNCYESIPADGKVIIVECILPVYPETNLASNACFQLDNIMLAHNPGGKERTEKDFEALSAKAGFTGFKIICGAFGSWVMEFCK

SEQ ID NO: 483 - protein, 359 aa, Capsicum chinense
  misc_feature (1)..(359): Public GI ID no.29839258
  misc_feature (1)..(359): Bit score of 980.5 for HMM based on sequences of FIGURE 19.
  misc_feature (30)..(81): Pfam Name: Dimerisation Pfam Description: Dimerisation domain
  misc_feature (90)..(336): Pfam Name: Methyltransf_2 Pfam Description: O-methyltransferase
  misc_feature (90)..(336): Pfam Name: Methyltransf_2 Pfam Description: O-methyltransferase
  misc_feature (1)..(359): Bit score of 980.5 for HMM based on sequences of FIGURE 19.
  misc_feature (1)..(359): Functional Homolog Of Ceres ANNOT ID no. 1520476 at SEQ ID NO. 342
MGSINQSLTQTEDEAFVFAMQLASASVLPMVLKATVELDLLEIMAKSGPGAFISPSELAAQLPTKNPEAPVMLDRMFRLLATYSVLNCTLRTLPDGRVERLYSLAPVCKFLTKNGDGVSIAPILLMNQDKVLMESWYHLTDAVLDGGVPFNKAYGMTTFEYHGTDPRFNKVFNCGMSDHTTLSMKKILEDYTGFEGLNSIVDVGGGTGATVNMIVSKYPSIKGINFDLPHVIRDAPSYPGVEQVGGDMFVSVPKADAIFMKWICHDWSDDHCIKLLKNCYEALPANGKVIIVECILPEAPDTSAATKSKVHGDIIMLAHNPGGKERTEKDFEALANWGWFSRFRKVCCAYHTWVMEFNK

SEQ ID NO: 484 - protein, 365 aa, Boehmeria nivea
  misc_feature (1)..(365): Public GI ID no.109255537
  misc_feature (1)..(365): Bit score of 1055.0 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1055 for HMM based on sequences of FIGURE 19.
  misc_feature (1)..(365): Functional Homolog Of Ceres ANNOT ID no. 1520476 at SEQ ID NO. 342
MGSTGETQMTPTQVSDEEANLFAMQLASASVLPMVLKTAIELDLLEIIAKAGPGAWLSPAEIAAQLPTTNPAAPVMLDRILRLLACYSVVACQLRTLPGGAAERLYGLAPVCKFLTKNNDGVSISPLCLMNQDKVLMESWYYLKDAVLEGGIPFNKAYGMTAFEYHGTDPRFNKVFNRGMSDHSTITMKKLLETYKGFEGLNSVVDVGGGTGAVLSMIVSNYPSIKGINFDLPHVIEDAPAYPGVEHVGGDMFVSVPKGDAIFMKWICHDWSDEHCLKFLKSCYDALPNNGKVIVAECILPVAPDTSLATKGVAHIDVIMLAHNPGGKERAEKEFQALAKGAGFQGFRVVCSAFNTYVMEFLKKP

SEQ ID NO: 485 - protein, 356 aa, Hordeum vulgare subsp. vulgare
  misc_feature (1)..(356): Public GI ID no.148337324
  misc_feature (1)..(356): Bit score of 924.3 for HMM based on sequences of FIGURE 19.
  misc_feature (27)..(78): Pfam Name: Dimerisation Pfam Description: Dimerisation domain
  misc_feature (87)..(333): Pfam Name: Methyltransf_2 Pfam Description: O-methyltransferase
  misc_feature (87)..(333): Pfam Name: Methyltransf_2 Pfam Description: O-methyltransferase
  misc_feature (1)..(356): Bit score of 924.3 for HMM based on sequences of FIGURE 19.
  misc_feature (1)..(356): Functional Homolog Of Ceres ANNOT ID no. 1520476 at SEQ ID NO. 342
MGSIAAGADEDACMYALQLVSSSILPMTLKNAIELGLLETLMSAGGKFLTPAEVAAKLPSTANPEAPDMVDRMLRLLASYKVVSCRTEESKDGRLSRRYGAAPVCKYLTPNEDGVSMSALALMNQDKVLMESWYYLKDAVLDGGIPFNKAYGMSAFEYHGTDPRFNRVFNEGMKNHSIIITKKLLESYKGFEGLGTLVDVGGGVGATVGAIIARYPAVKGINFDLPHVISEAPAFPGVTHIGGDMFQKVPSGDAILMKWILHDWSDEHCATLLKNCYDALPAHGKVVLVECILPVNPEATPEVQGVFHVDMIMLAHNPGGRERYEREFEALAKGAGFAAMKTTYIYANAWAIEFTK

SEQ ID NO: 486 - protein, 360 aa, Populus tomentosa
  misc_feature (1)..(360): Public GI ID no.7528266
  misc_feature (1)..(360): Bit score of 1042.5 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(360): Bit score of 1042.5 for HMM based on sequences of FIGURE 19.
  misc_feature (1)..(360): Functional Homolog Of Ceres ANNOT ID no. 1520476 at SEQ ID NO. 342
MGSTGETQMTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILEGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHVDVIMLAHNPGGKERTEKEFEGLANGAGFQGFEVMCCAFNTHVIE

SEQ ID NO: 487 - protein, 362 aa, Saccharum hybrid cultivar
  misc_feature (1)..(362): Public GI ID no.34398680
  misc_feature (1)..(362): Bit score of 943.5 for HMM based on sequences of FIGURE 19.
  misc_feature (31)..(85): Pfam Name: Dimerisation Pfam Description: Dimerisation domain
  misc_feature (94)..(339): Pfam Name: Methyltransf_2 Pfam Description: O-methyltransferase
  misc_feature (94)..(339): Pfam Name: Methyltransf_2 Pfam Description: O-methyltransferase
  misc_feature (1)..(362): Bit score of 943.5 for HMM based on sequences of FIGURE 19.
  misc_feature (1)..(362): Functional Homolog Of Ceres ANNOT ID no. 1520476 at SEQ ID NO. 342
MGSTAEDVAAVADEEACMYAMQLASASILPMTLKNALELGLLEVLQAEAPAGKALAPEEVVARLPVAPTNPDAADMVDRMLRLLASYDVVKCQMEDKDGKYERRYSAAPVGKWLTPNEDGVSMAALTLMNQDKVLMESWYYLKDAVLDGGIPFNKAYGMTAFEYHGTDPRFNRVFNEGMKNHSVIITKKLLEFYTGFEGVSTLVDVGGGIGATLHAITSHHPQIKGINFDLPHVISEAPPFPGVQHVGGDMFKSVPAGDAILMKWILHDWSDAHCATLLKNCYDALPENGKVIVVECVLPVNTEAVPKAQGVFHVDMIMLAHNPGGRERYEREFHDLAKGAGFSGFKATYIYANAWAIEFIK

SEQ ID NO: 488 - protein, 353 aa, Citrus sinensis x Citrus reticulata
  misc_feature (1)..(353): Public GI ID no.145695037
  misc_feature (1)..(353): Bit score of 806.2 for HMM based on sequences of FIGURE 19.
  misc_feature (27)..(78): Pfam Name: Dimerisation Pfam Description: Dimerisation domain
  misc_feature (87)..(330): Pfam Name: Methyltransf_2 Pfam Description: O-methyltransferase
  misc_feature (1)..(353): Bit score of 806.2 for HMM based on sequences of FIGURE 19.
  misc_feature (1)..(353): Functional Homolog Of Ceres ANNOT ID no. 1520476 at SEQ ID NO. 342
MDSIVDGERDQSFAYANQLAMGTMLPMAIQTVYELGIFEILDKVGPGAKLCASDIAAQLLTKNKDAPMMLDRILRLLASYSVVECSLDASGARRLYSLNSVSKYYVPNKDGVLLGPLIQIVQDKVFLKSWSQLKDAILEGGIPFNRAHGVHVFEYTGLDPKFNKHFNTAMYNYTSLVMSNILESYKGFDNIKQLVDVGGSLGITLQAITTKYPYIKGINFDQPHVIDHAPPHPRIEHVGGDMFQSVPKGDAIFMKSVLHDWNDEHCLKLLKNCYKSIPEDGKVIVVESMLPEVPNTSIESKSNSHLDVLMMIQSPGGKERTRHEFMTLATGAGFGGISCELAIGSLWVMEFYK

SEQ ID NO: 489 - protein, 355 aa, Thalictrum flavum subsp. glaucum
  misc_feature (1)..(355): Public GI ID no.51980212
  misc_feature (1)..(355): Bit score of 516.5 for HMM based on sequences of FIGURE 19.
  misc_feature (23)..(74): Pfam Name: Dimerisation Pfam Description: Dimerisation domain
  misc_feature (84)..(325): Pfam Name: Methyltransf_2 Pfam Description: O-methyltransferase
  misc_feature (1)..(355): Bit score of 516.5 for HMM based on sequences of FIGURE 19.
  misc_feature (1)..(355): Functional Homolog Of Ceres ANNOT ID no. 1520476 at SEQ ID NO. 342
MALQEGVNYLSGLGLSRLICLPMALRAAIELNVFEIIFQAGPEAQLSPAEIVAKIPTKNPNAAIALDRILRMLGASSILSVTTMKDGRVYGLTEESRCLVADKNGVSVVPMLLFTSDKAVVESFYNIKDVVLEEGVIPFDRTHGMDFFAYAGKEQSVNKSFNQAMGAGSTIAFDEVFKVYKGFHDLKELVNVGGGIGTSLSNIIFKYPHIKGINFELPHVIADAPNYPGVEHIAGNMFEGVPNAQNILLKWVLHDWDDERSIKILQNCWKALPEGGTVIVVEFVLPQILGNNAESFNALTPDLLMMTLNPGGKERTTTEFDGLAKAAGFAETKFFPISQGLHVMEFHKATAGVAS

SEQ ID NO: 490 - protein, 363 aa, Isatis indigotica
  misc_feature (1)..(363): Public GI ID no.74053618
  misc_feature (1)..(363): Bit score of 847.4 for HMM based on sequences of FIGURE 19.
  misc_feature (33)..(82): Pfam Name: Dimerisation Pfam Description: Dimerisation domain
  misc_feature (93)..(338): Pfam Name: Methyltransf_2 Pfam Description: O-methyltransferase
  misc_feature (1)..(363): Bit score of 847.4 for HMM based on sequences of FIGURE 19.
  misc_feature (1)..(363): Functional Homolog Of Ceres ANNOT ID no. 1520476 at SEQ ID NO. 342
MGSTVDPPTPVQITDEETSLFAMKLASSSVLPMALQSALELDLLEIMAKNASQMSPAEIGSHLPTKNPEAPVMLDRILRLLSAYSILTCSIRKVPGGDTIERLYGLGPVCKYLTKNVDGVSIAALCLMNQDKVFIESWYHLKDAILVGGSAFNKAYGMSVLEYQRTDTRFNKVVNNGMSNHSTIAMKKILETYKGFDGLISVVDVGGGNGATLKMIVSKYPNLKGINFDLPHVIKDAPSYPGIEHVGGDMFVSVPKGDAMIMKWICHARSDKQCLKFLKNCYDALPENGKVIVAECILPENLDSSLLTKQALHVDCIMLAHSGGGKERTAKELEALAKGSGFHGIKVVCNAFGIHFIEMLKKF

SEQ ID NO: 491 - protein, 365 aa, Rosa chinensis var. spontanea
  misc_feature (1)..(365): Public GI ID no.32440933
  misc_feature (1)..(365): Bit score of 1053.9 for HMM based on sequences of FIGURE 19.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1053.9 for HMM based on sequences of FIGURE 19.
  misc_feature (1)..(365): Functional Homolog Of Ceres ANNOT ID no. 1520476 at SEQ ID NO. 342
MGSTGETQMTPTQVSDEEANLFAMQLASASVLPMVLKAAIELDLLEIMAKAGPGAFLSPNDLASQLPTKNPEAPVMLDRMLRLLASYSILTYSLRTLPDGKVERLYGLGPVCKFLTKNEDGVSIAALCLMNQDKVLVESWYHLKDAVLDGGIPFNKAYGMTAFDYHGTDPRFNKVFNKGMADHSTITMKKILETYKGFEGLTSIVDVGGGTGAVVNMIVSKYPSIKGINFDLPHVIEDAPQYPGVQHVGGDMFVSVPKGDAIFMKWICHDWSDEHCLKFLKNCYAALPDNGKVILGECILPVAPDTSLATKGVVHIDVIMLAHNPGGKERTGQEFEALAKGSGFQGIRVACNAFNTYVIEFLKKI

SEQ ID NO: 492 - protein, 257 aa, Picea glauca
  misc_feature (1)..(257): Public GI ID no.147744710
  misc_feature (1)..(257): Bit score of 465.9 for HMM based on sequences of FIGURE 15.
  misc_feature (67)..(112): Pfam Name: Myb_DNA-binding Pfam Description: Myb-like DNA-binding domain
  misc_feature (1)..(257): Bit score of 465.9 for HMM based on sequences of FIGURE 15.
  misc_feature (1)..(257): Functional Homolog Of Ceres ANNOT ID no. 858797 at SEQ ID NO. 342
MGRSPCCEKAHTNKGAWTKEEDDRLIAHIRAHGEGCWRSLPKAAGLMRCGKSCRLRWINYLRPDLKRGNFSEEEDELIIKLHSLLGNKWSLIAGRLPGRTDNEIKNYWNTHIKRKLLNKGLDPQSHRPLGQVHSSNTTCSSLPAPEHEILAFQSPRTPEIADFFQYERSESSPIEPAASKDEEYPDLNLELCISLPVHSAPAASRASSVDRTVDSKPNSGSELCCPMGLQVNYGAQCENRYSEENASGFSSHYRLVL

SEQ ID NO: 493 - protein, 210 aa, Picea glauca
  misc_feature (1)..(210): Public GI ID no.147744720
  misc_feature (1)..(210): Bit score of 391.1 for HMM based on sequences of FIGURE 15.
  misc_feature (67)..(112): Pfam Name: Myb_DNA-binding Pfam Description: Myb-like DNA-binding domain
  misc_feature (1)..(210): Bit score of 391.1 for HMM based on sequences of FIGURE 15.
  misc_feature (1)..(210): Functional Homolog Of Ceres ANNOT ID no. 858797 at SEQ ID NO. 342
MGRSPCCEKSHTNKGAWTKEEDDRLIAHIRAHGEGGWRSLPKAAGLLRCGKSCRLRWINYLRPDLKRGNFSEEEDELIIKLHSILGNKWSLIAARLPGRTDNEIKNYWNSHIKRKLLSRGLDPGSHRPLCFPHHNNTTSPSRPAPDHEFPAFQNLKTPEITDFFQQYRSESSPIVPEASDAEEHPDLNLNLCISLPSNSPPRREQSFQRP

SEQ ID NO: 494 - protein, 233 aa, Pinus taeda
  misc_feature (1)..(233): Public GI ID no.89058600
  misc_feature (1)..(233): Bit score of 413.3 for HMM based on sequences of FIGURE 15.
  misc_feature (67)..(112): Pfam Name: Myb_DNA-binding Pfam Description: Myb-like DNA-binding domain
  misc_feature (1)..(233): Bit score of 413.3 for HMM based on sequences of FIGURE 15.
  misc_feature (1)..(233): Functional Homolog Of Ceres ANNOT ID no. 858797 at SEQ ID NO. 342
MGRTPCCEKAHTNKGAWTQEEDARLVAHIQAHGEGGWRSLPKAAGLLRCGKSCRLRWINYLRPDLKRGNFSEQEDELIIKFHSRLGNKWSLIARILPGRTDNEIKNHWNTHIKKKLVRMGLDPKSHLPLGEPRDSNTTYTVLASPKHKIPPFQSPRTPDIADFFQYDRSGSSTMELVASKAEEHPELNLDLSISLPSHSTPATTRASTVHRTVDSNSNSGSGLWCLTGMEAIS

SEQ ID NO: 495 - protein, 265 aa, Humulus lupulus
  misc_feature (1)..(265): Public GI ID no.124430478
  misc_feature (1)..(265): Bit score of 560.2 for HMM based on sequences of FIGURE 15.
  misc_feature (67)..(112): Pfam Name: Myb_DNA-binding Pfam Description: Myb-like DNA-binding domain
  misc_feature (1)..(265): Bit score of 560.2 for HMM based on sequences of FIGURE 15.
  misc_feature (1)..(265): Functional Homolog Of Ceres ANNOT ID no. 858797 at SEQ ID NO. 342
MGRSPCCEKAHTNKGAWTKEEDDRLIAYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNESGQETTNTSTTTTATTTTTTTASNTTTTISFAASTVKEEEKTTSVLLNPIQEQCPDLNLELRISPPYPHQQRQPDQLKSGGASLCFACSLGLQNSKECCCTISSMDSNNPSTSVGYDFLGLKSGVLDYRSLEMK

SEQ ID NO: 496 - protein, 264 aa, Gossypium hirsutum
  misc_feature (1)..(264): Public GI ID no.13346194
  misc_feature (1)..(264): Bit score of 559.9 for HMM based on sequences of FIGURE 15.
  misc_feature (67)..(112): Pfam Name: Myb_DNA-binding Pfam Description: Myb-like DNA-binding domain
  misc_feature (1)..(264): Bit score of 559.9 for HMM based on sequences of FIGURE 15.
  misc_feature (1)..(264): Functional Homolog Of Ceres ANNOT ID no. 858797 at SEQ ID NO. 342
MGRSPCCEKAHTNKGAWTKEEDDRLIAYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPATHRPLNEASQDVTTISFSGAKEEKEKINTNSNNNPIGFITKDEKKIPVQERCPDLNLDLRISPPYYQQTQPESFKTGGRTLCFICSLGVKNSKDCTCSTITTAAGSSSSSSSHSNSNNSSGYDFLGLKSGILEYRSLEMK

SEQ ID NO: 497 - DNA, 1241 bp, Gossypium hirsutum
  misc_feature (1)..(1241): Ceres CLONE ID no.1836832
  misc_feature (1)..(1241): Encodes the peptide sequence at SEQ ID NO 498
agaggctaccagccactcccctcaaacctgtctcaccaactcacatctagaagctaaaattagggtcactgcgctctttctctttctggttgtgtgtgtgtgtaatagtcaaaaggctatataaaaaagcatctaaagtgctctcaaagggccggcctcaatgttcctgcaacacaaaaaacaaggcctccatttcattttccacccttactacttctcctagattctaaatataatatatacacgcacatatatatgatatcatagtatattttatactagtttgtatagtattgaaaaactgcaaacgtaggctactagtgctgctagtttccacaagttgaaaaaggtttctttgtgttactgaattatgggaaggtctccttgttgtgagaaagctcatacgaacaaaggtgcgtggactaaagaagaagatgatcgcctcatagcttacatccgagcccatggtgaaggttgctggcgttcactccctaaagctgctggccttctccgctgtggcaaaagttgtagacttcgttggatcaattacttaagacctgatcttaaacgtggcaatttcactgaagaagaagatgagctcattatcaagctgcacagccttcttggtaacaagtggtctcttatagctgggagattaccaggaagaacagataatgagataaagaattactggaacacgcatataagaaggaagctattgagcagaggtattgatccagcaactcacagaccactcaatgaggcttctcaggatgtaacaacaatatctttcagtggtgccaaagaagagaaagagaagattaatactaacagcaataataaccctattggatttatcaccaaagctgaaaagagaatcccagttcaagaaaggtgtccggacttgaatttggacctcagaattagccctccttattaccagcaaacccccccagagtcattcaaaactggaggaagaactctttgttttatttgcagcttgggagttaaaaacagcaaagattgcacttgcagcaccattactactgctgctggtagcagcagcagtagcagtagccacagcaacagcaacaacagcagtggttatgatttcttaggcttgaaagctggtatcttggaatatagaagtttggaaatgaaataatagagtgaaaatttggatttttaactatgtagttcaactccctcccccccccccccaaaaaaaaaaaaaaaaaaaa

SEQ ID NO: 498 - protein, 264 aa, Gossypium hirsutum
  misc_feature (1)..(264): Ceres CLONE ID no.1836832
  misc_feature (1)..(264): Bit score of 558.8 for HMM based on sequences of FIGURE 15.
  misc_feature (67)..(112): Pfam Name: Myb_DNA-binding Pfam Description: Myb-like DNA-binding domain
  misc_feature (1)..(264): Bit score of 558.8 for HMM based on sequences of FIGURE 15.
  misc_feature (1)..(264): Functional Homolog Of Ceres ANNOT ID no. 858797 at SEQ ID NO. 342
MGRSPCCEKAHTNKGAWTKEEDDRLIAYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPATHRPLNEASQDVTTISFSGAKEEKEKINTNSNNNPIGFITKAEKRIPVQERCPDLNLDLRISPPYYQQTPPESFKTGGRTLCFICSLGVKNSKDCTCSTITTAAGSSSSSSSHSNSNNSSGYDFLGLKAGILEYRSLEMK

SEQ ID NO: 499 - protein, 294 aa, Gossypium hirsutum
  misc_feature (1)..(294): Public GI ID no.23476279
  misc_feature (1)..(294): Bit score of 444.3 for HMM based on sequences of FIGURE 15.
  misc_feature (67)..(112): Pfam Name: Myb_DNA-binding Pfam Description: Myb-like DNA-binding domain
  misc_feature (1)..(294): Bit score of 444.3 for HMM based on sequences of FIGURE 15.
  misc_feature (1)..(294): Functional Homolog Of Ceres ANNOT ID no. 858797 at SEQ ID NO. 342
MGRSPCCEKAHTNKGAWTKEEDQRLINYIRVHGEGCWRSLPKAAGLLRCGKSCRLRWINYLRPDLKRGNFTEEEDELIIKLHSLLGNKWSLIAGRLPGRTDNEIKNYWNTHIKRKLISRGIDPQTHRPLNQTANTNTVTAPTELDFRNTPTSVSKSSSIKNPSLDFNYNEFQFKSNTDSLEEPNCTTSSGMTTDEEQQEQLHKQQQYDPSNGQDLNLELSIGIVSADSSRVSSANSAESKPKVDNNNFQFLEQAMVAKAVCLCWQLGFGTSEICRNCQNSNSNGFYSYCRPLDS

SEQ ID NO: 500 - protein, 294 aa, Gossypium hirsutum
  misc_feature (1)..(294): Public GI ID no.437327
  misc_feature (1)..(294): Bit score of 444.1 for HMM based on sequences of FIGURE 15.
  misc_feature (67)..(112): Pfam Name: Myb_DNA-binding Pfam Description: Myb-like DNA-binding domain
  misc_feature (1)..(294): Bit score of 444.1 for HMM based on sequences of FIGURE 15.
  misc_feature (1)..(294): Functional Homolog Of Ceres ANNOT ID no. 858797 at SEQ ID NO. 342
MGRSPCCEKAHTNKGAWTKEEDQRLINYIRVHGEGCWRSLPKAAGLLRCGKSCRLRWINYLRPDLKRGNFTEEEDELIIKLHSLLGNKWSLIAGRLPGRTDNEIKNYWNTHIKRKLISRGIDPQTHRPLNQTANTNTVTAPTELDFRNSPTSVSKSSSIKNPSLDFNYNEFQFKSNTDSLEEPNCTASSGMTTDEEQQEQLHKKQQYGPSNGQDINLELSIGIVSADSSRVSNANSAESKPKVDNNNFQFLEQAMVAKAVCLCWQLGFGTSEICRNCQNSNSNGFYSYCRPLDS

SEQ ID NO: 501 - DNA, 999 bp, Gossypium hirsutum
  misc_feature (1)..(999): Ceres CLONE ID no.1976145
  misc_feature (1)..(999): Encodes the peptide sequence at SEQ ID NO 502
atgtgctcattttagcgcacacatacacgcactctctctctctctctctctcgagtttacatcacctcttttctggtttttgtgatcatttcagattgtgcggctggaatcgtagaagaaagaaaaaaaaaatgggaagagccccatgttgttctaaggtaggtttgaaccgaggtccttggacagccagagaagacacattgctgattaattatatacaggctcatggagaaggtcattggagatctttgcctaaaatggctgggttgcttaggtgcggaaaaagctgccgactaagatggattaactatctccgacctgatatcaagcgaggaaacattactcccgacgaggacgacctcattatcaggcttcattctcttctgggaaatcgttggtctctcattgctaaaagacttccaggcaggaccgacaatgaaatcaagaactactggaattctcacctcagcaaaagggtgctcaataattcacaaactaattcaactacaagaagcagccgtaaagccaagaaagccactgaaaagaagcaaaaggccaatgtggaggagaaagaagagataaaggtgctgcatcaaccaaaagccagcagggtttcgccattctcagtaatatcaaggagcagcagttttgacagcctcataagtgggtcatctagcagcggtgaagggagcaaaggaaccaatgatgcctatgttttttatattcctagctattggtccgactttgcagctgatactaacctagaatttcctgacgctgaggcgttttcagatgccacacccgtaggagatagtaatttgcttgacgacatttttgaagaataccagaaacttcttgatggcgatgaccctggcgaaagagattccatatttgatgttctctcttgtttttgagtattttctgctacaagattctccactgtataattcaatctcaatgaactactaattaaaatcctaaaaaaaaaaaaaaaaaaaa

SEQ ID NO: 502 - protein, 260 aa, Gossypium hirsutum
  misc_feature (1)..(260): Ceres CLONE ID no.1976145
  misc_feature (1)..(260): Bit score of 349.4 for HMM based on sequences of FIGURE 15.
  misc_feature (67)..(112): Pfam Name: Myb_DNA-binding Pfam Description: Myb-like DNA-binding domain
  misc_feature (1)..(260): Bit score of 349.4 for HMM based on sequences of FIGURE 15.
  misc_feature (1)..(260): Functional Homolog Of Ceres ANNOT ID no. 858797 at SEQ ID NO. 342
MGRAPCCSKVGLNRGPWTAREDTLLINYIQAHGEGHWRSLPKMAGLLRCGKSCRLRWINYLRPDIKRGNITPDEDDLIIRLHSLLGNRWSLIAKRLPGRTDNEIKNYWNSHLSKRVLNNSQTNSTTRSSRKAKKATEKKQKANVEEKEEIKVLHQPKASRVSPFSVISRSSSFDSLISGSSSSGEGSKGTNDAYVFYIPSYWSDFAADTNLEFPDAEAFSDATPVGDSNLLDDIFEEYQKLLDGDDPGERDSIFDVLSCF

SEQ ID NO: 503 - protein, 294 aa, Cucumis sativus
  misc_feature (1)..(294): Public GI ID no.83638483
  misc_feature (1)..(294): Bit score of 323.6 for HMM based on sequences of FIGURE 15.
  misc_feature (14)..(61): Pfam Name: Myb_DNA-binding Pfam Description: Myb-like DNA-binding domain
  misc_feature (1)..(294): Bit score of 323.6 for HMM based on sequences of FIGURE 15.
  misc_feature (1)..(294): Functional Homolog Of Ceres ANNOT ID no. 858797 at SEQ ID NO. 342
MGRPPCCEKVGIKKGPWTPEEDIILVSYIQQHGPGNWRSVPTNTGLLRCSKSCRLRWTNYLRPGIKRGNFTPHEEGMIIHLQALLGNKWAAIASYLPQRTDNDIKNYWNTHLKKKLKKLNSAAVDTPEPPESATTRFQSNDKVPTADSPSSLVSNRATTYASSAENISRLLQAWMRSSPEESRRKMSGENSIAAATQQQQQPKAEPDGGELVSGEEFDSILSFENMKSVNSWGKSSLSYKGKEEVNVGEKQSSENDDATAENATAPPLSFLEKWLFEEGAAGQVEEMMELSPVF

SEQ ID NO: 504 - DNA, 816 bp, Populus balsamifera subsp. trichocarpa
  misc_feature (1)..(816): Ceres ANNOT ID no.1460633
  misc_feature (1)..(816): Encodes the peptide sequence at SEQ ID NO 505
atgggaaggtctccttgctgtgaaaaagcccatacaaacaagggtgcgtggaccaaggaggaagacgatcgccttgttgcttacattagagctcacggtgaaggttgctggcgctcacttcctaaagccgctggccttcttagatgtggcaagagttgcagacttcgttggatcaactatttaagacctgaccttaaacgtggcaatttcaccgaagcagaagatgagctcattatcaaactccatagcctccttggaaacaaatggtcactcatagctggaagattaccagggagaacagataatgagataaagaattattggaacacacatataagaaggaagcttttgaacagaggcatagatcccgcaactcataggccactcaacgaaccagcagtacaagaagccacaacaacaatatctttcaccacgactactacttcagtacttgaagaagagtctctgggttctataattaaagaggaaaataaagagaagataattagcgcaactgctttcgtatgcaaagaagagaaaacccaagttcaagaaaggtgtccagacttgaatctcgagcttggaattagccttccttcccaaaaccagcctgatcatcaccagccattcaaaactggaggaagtagaagtctttgttttgcttgcagtttggggctacaaaacagcaaggattgcagctgcaatgttattgtgagcactgttgggagcagtggcagcactagcacaaagactggttatgacttcttgggcatgaaaagtggtgttttggattatagaagtttagagatgaaataa

SEQ ID NO: 505 - protein, 271 aa, Populus balsamifera subsp. trichocarpa
  misc_feature (1)..(271): Ceres ANNOT ID no.1460633
  misc_feature (1)..(271): Bit score of 564.7 for HMM based on sequences of FIGURE 15.
  misc_feature (67)..(112): Pfam Name: Myb_DNA-binding Pfam Description: Myb-like DNA-binding domain
  misc_feature (1)..(271): Bit score of 564.7 for HMM based on sequences of FIGURE 15.
  misc_feature (1)..(271): Functional Homolog Of Ceres ANNOT ID no. 858797 at SEQ ID NO. 342
MGRSPCCEKAHTNKGAWTKEEDDRLVAYIRAHGEGCWRSLPKAAGLLRCGKSCRLRWINYLRPDLKRGNFTEAEDELIIKLHSLLGNKWSLIAGRLPGRTDNEIKNYWNTHIRRKLLNRGIDPATHRPLNEPAVQEATTTISFTTTTTSVLEEESLGSIIKEENKEKIISATAFVCKEEKTQVQERCPDLNLELGISLPSQNQPDHHQPFKTGGSRSLCFACSLGLQNSKDCSCNVIVSTVGSSGSTSTKTGYDFLGMKSGVLDYRSLEMK

SEQ ID NO: 506 - DNA, 813 bp, Populus balsamifera subsp. trichocarpa
  misc_feature (1)..(813): Ceres ANNOT ID no.1471346
  misc_feature (1)..(813): Encodes the peptide sequence at SEQ ID NO 507
atgggaagggctccttgttgctccaaggttggcttgcatagaggaccgtggactcccagagaagacacgttgcttaccaagtatattcaagctcacggtgaaggccattggaggtctttgcctaaaaaagctggtctcctcagatgtggcaaaagttgcaggctaagatggatgaactatctaagaccagacatcaagagaggaaatatcacccctgatgaggatgatctcattattagaatgcattccctacttggtaaccggtggtctctcattgccggaaggcttccaggtcgaaccgataatgagatcaagaattactggaacactcatctcgttaagagacttagaagccaaggaattactgaccccggcacccacagaaagttagcagaaccaggagaacgtgaagtgaagagaaggagaagtaacaaaaacaccagtaacaagaaacaaaacaaaagcaaagcaaaactaattttgcctgctgaaaagcataaggtccacctccctaaacctgttaggtttacctctttacctttaccaagaaatgacagttttgagagcaatacaattactatttctccaagccaaggaagagatcaagggtctttcggtaccggggatagctttcttgttggagataatgatcgatacggtcttgttaatggttcagatcttgaatgccagtctcctgtgcctacgacaaacacattagagaagctgtatgaggagtatcttcagctcctggagatagatgatcgtcaggatcaagtactattagactcctttgccgattcattgttggtatga

SEQ ID NO: 507 - protein, 270 aa, Populus balsamifera subsp. trichocarpa
  misc_feature (1)..(270): Ceres ANNOT ID no.1471346
  misc_feature (1)..(270): Bit score of 405.3 for HMM based on sequences of FIGURE 15.
  misc_feature (67)..(112): Pfam Name: Myb_DNA-binding Pfam Description: Myb-like DNA-binding domain
  misc_feature (1)..(270): Bit score of 405.3 for HMM based on sequences of FIGURE 15.
  misc_feature (1)..(270): Functional Homolog Of Ceres ANNOT ID no. 858797 at SEQ ID NO. 342
MGRAPCCSKVGLHRGPWTPREDTLLTKYIQAHGEGHWRSLPKKAGLLRCGKSCRLRWMNYLRPDIKRGNITPDEDDLIIRMHSLLGNRWSLIAGRLPGRTDNEIKNYWNTHLVKRLRSQGITDPGTHRKLAEPGEREVKRRRSNKNTSNKKQNKSKAKLILPAEKHKVHLPKPVRFTSLPLPRNDSFESNTITISPSQGRDQGSFGTGDSFLVGDNDRYGLVNGSDLECQSPVPTTNTLEKLYEEYLQLLEIDDRQDQVLLDSFADSLLV

SEQ ID NO: 508 - protein, 266 aa, Brassica rapa
  misc_feature (1)..(266): Public GI ID no.119720796
  misc_feature (1)..(266): Bit score of 184.2 for HMM based on sequences of FIGURE 15.
  misc_feature (75)..(99): Pfam Name: Myb_DNA-binding Pfam Description: Myb-like DNA-binding domain
  misc_feature (1)..(266): Bit score of 184.2 for HMM based on sequences of FIGURE 15.
  misc_feature (1)..(266): Functional Homolog Of Ceres ANNOT ID no. 858797 at SEQ ID NO. 342
MISSSNSIASLGTSENLHKTLQQTRSSVLRILCLVCSVLDFSHTLFLMLSFSDTLFLMLCFSHTLFLMLCFFHLRWSLIATRLPGRTDNEIKNYWNTHVKRKLLRGGIDPTTHRPINESKAPRDSPETRETEDSLVKFLSFSRQLEKNDQKGLICKKERVEYSVVEEKCLDLNLELRISPPWQDQQHHDETKLWFGREKYKCTACRFGLGNGKECSCDNVKCQVEDSSSSSSYSSSDISSSVIGCYDFLGLKLNTSVLDFSTSEMN

SEQ ID NO: 509 - protein, 253 aa, Glycine max
  misc_feature (1)..(253): Public GI ID no.110931646
  misc_feature (1)..(253): Bit score of 552.1 for HMM based on sequences of FIGURE 15.
  misc_feature (67)..(112): Pfam Name: Myb_DNA-binding Pfam Description: Myb-like DNA-binding domain
  misc_feature (1)..(253): Bit score of 552.1 for HMM based on sequences of FIGURE 15.
  misc_feature (1)..(253): Functional Homolog Of Ceres ANNOT ID no. 858797 at SEQ ID NO. 342
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEAASAATVTTATTNISFGKQQEQETSSSNGSVVKGSILERCPDLNLELTISPPRQQQPQKNLCFVCSLGLNNSKDCSCNVANTVTVTVSNTTPSSAAAAAAAAYDFLGMKTNGVWDCTRLEMK

SEQ ID NO: 510 - protein, 247 aa, Glycine max
  misc_feature (1)..(247): Public GI ID no.114384137
  misc_feature (1)..(247): Bit score of 544.4 for HMM based on sequences of FIGURE 15.
  misc_feature (67)..(112): Pfam Name: Myb_DNA-binding Pfam Description: Myb-like DNA-binding domain
  misc_feature (1)..(247): Bit score of 544.4 for HMM based on sequences of FIGURE 15.
  misc_feature (1)..(247): Functional Homolog Of Ceres ANNOT ID no. 858797 at SEQ ID NO. 342
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEAATAATVTTNISFGKQEQQETSSSNGSVVKGSILERCPDLNLELTISPPRQQQQTQKNLCFVCSLGLHNSKDCSCNVSNAVTVNNTTPSSAAAAAAYDFLGMKTSGVWDCTRLEMK

SEQ ID NO: 511 - protein, 217 aa, Glycine max
  misc_feature (1)..(217): Public GI ID no.110931806
  misc_feature (1)..(217): Bit score of 496.7 for HMM based on sequences of FIGURE 15.
  misc_feature (67)..(112): Pfam Name: Myb_DNA-binding Pfam Description: Myb-like DNA-binding domain
  misc_feature (1)..(217): Bit score of 496.7 for HMM based on sequences of FIGURE 15.
  misc_feature (1)..(217): Functional Homolog Of Ceres ANNOT ID no. 858797 at SEQ ID NO. 342
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEAATAATVTTNISFGKQEQQETSSSNGSVVKGSILERCPDLNLELTISPPRQQQQTQKNLCFVCSLGLHNSKDCSCNVSNAVTVNNT

SEQ ID NO: 512 - DNA, 859 bp, Glycine max
  misc_feature (1)..(859): Ceres CLONE ID no.1642529
  misc_feature (1)..(859): Encodes the peptide sequence at SEQ ID NO 513
gttggagagagagatgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttcaccctcgaagaagaccaactcatcatcaaactccatagcctccttggcaacaagtggtctctaattgctggaagattgccgggtagaacggacaatgagataaagaattactggaatactcacataagaaggaagcttctgagcagaggtattgaccctgccactcacaggcctctcaacgatgacaaggtattggaacgctgccctgacttgaaccttgagctaaccattagtcctccccgtcaacctcaatctgatcagcatcacttgaagcccgttgggagaaactcaaacctttgctttgcctgcagtttgggtttgcaaaatagcaaagatcattgtagctgtgcgctcaacactgccaacgctgcttctggccatgatttcttggccttgaaaaccagcgttttggaaatgaaatgattcaaattcattttggaatctttcttccctaattaattagttgttaatggatgcaaatgattgcctgcccaatttcctcgtggagccctttctattattcctatgttcatgtacatgtgcgtaagactacaaactttcttgtttatacgattggttctttccaaatagaatacaactatatatttttgttatttccaaaaaaaaaaaaaaaaa

SEQ ID NO: 513 - protein, 210 aa, Glycine max
  misc_feature (1)..(210): Ceres CLONE ID no.1642529
  misc_feature (1)..(210): Bit score of 484.0 for HMM based on sequences of FIGURE 15.
  misc_feature (67)..(112): Pfam Name: Myb_DNA-binding Pfam Description: Myb-like DNA-binding domain
  misc_feature (1)..(210): Bit score of 484 for HMM based on sequences of FIGURE 15.
  misc_feature (1)..(210): Functional Homolog Of Ceres ANNOT ID no. 858797 at SEQ ID NO. 342
MGRSPCCEKAHTNKGAWTKEEDHRLISYIRAHGEGCWRSLPKAAGLLRCGKSCRLRWINYLRPDLKRGNFTLEEDQLIIKLHSLLGNKWSLIAGRLPGRTDNEIKNYWNTHIRRKLLSRGIDPATHRPLNDDKVLERCPDLNLELTISPPRQPQSDQHHLKPVGRNSNLCFACSLGLQNSKDHCSCALNTANAASGHDFLALKTSVLEMK

SEQ ID NO: 514 - protein, 285 aa, Medicago truncatula
  misc_feature (1)..(285): Public GI ID no.92878899
  misc_feature (1)..(285): Bit score of 552.8 for HMM based on sequences of FIGURE 15.
  misc_feature (67)..(112): Pfam Name: Myb_DNA-binding Pfam Description: Myb-like DNA-binding domain
  misc_feature (1)..(285): Bit score of 552.8 for HMM based on sequences of FIGURE 15.
  misc_feature (1)..(285): Functional Homolog Of Ceres ANNOT ID no. 858797 at SEQ ID NO. 342
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEVSHSQSQSQTLHLQNQEAVTIAVAASTSTPTATKTLPTTISFASSIKQEQYHHHHHHQEMNTNMVKGLVLERCPDLNLELTISPPRVQEHDEQFRNRERNNLCFVCSLGLQNSKDCTCDEIVGNSSSGNGSTAPAYDFLGLKGGVWDYKGLEMK

SEQ ID NO: 515 - protein, 217 aa, Pisum sativum
  misc_feature (1)..(217): Public GI ID no.1841475
  misc_feature (1)..(217): Bit score of 302.4 for HMM based on sequences of FIGURE 15.
  misc_feature (69)..(114): Pfam Name: Myb_DNA-binding Pfam Description: Myb-like DNA-binding domain
  misc_feature (1)..(217): Bit score of 302.4 for HMM based on sequences of FIGURE 15.
  misc_feature (1)..(217): Functional Homolog Of Ceres ANNOT ID no. 858797 at SEQ ID NO. 342
MDKKPCNSSQDPEVRKGPWTMEEDLILINYIANHGEGVWNSLAKAAGLKRTGKSCRLRWLNYLRPDVRRGNITPEEQLLIMELHSKWGNRWSKIAKHLPGRTDNEIKNFWRTRIQKHIKQVDNPNQQNFQQKMSLEINDHHHHHPHQPSSSQVSNLVEPMETYSPTSYQGTLEPFPTQFPTINNDHHQNSNCCANDNNNNNYWSMEDIWSMQLLNGD

SEQ ID NO: 516 - protein, 255 aa, Eucalyptus gunnii
  misc_feature (1)..(255): Public GI ID no.39725415
  misc_feature (1)..(255): Bit score of 512.5 for HMM based on sequences of FIGURE 15.
  misc_feature (67)..(112): Pfam Name: Myb_DNA-binding Pfam Description: Myb-like DNA-binding domain
  misc_feature (1)..(255): Bit score of 512.5 for HMM based on sequences of FIGURE 15.
  misc_feature (1)..(255): Functional Homolog Of Ceres ANNOT ID no. 858797 at SEQ ID NO. 342
  misc_feature (214)..(214): Xaa is any aa, unknown, or other
MGRSPCCEKAHTNKGAWTKEEDDKLIAYIRAHGEGCWRSLPKAAGLLRCGKSCRLRWINYLRPDLKRGNFTEEEDEIIIKLHSLLGNKWSLIAGRLPGRTDNEIKNYWNTHIRRKLLNRGIDPATHRLINEPAQDHHDEPTISFAANSKEIKEMKNNAELNFMCNLEESADVASSARERCPDLNLELGISPPSHQLHQPEPLLRFTGRKSDLCXECNLGLKNSQNCRCSVGVIESETSVGYDFLGLKASVLDYRS

SEQ ID NO: 517 - protein, 273 aa, Solanum lycopersicum
  misc_feature (1)..(273): Public GI ID no.1167484
  misc_feature (1)..(273): Bit score of 531.7 for HMM based on sequences of FIGURE 15.
  misc_feature (67)..(112): Pfam Name: Myb_DNA-binding Pfam Description: Myb-like DNA-binding domain
  misc_feature (1)..(273): Bit score of 531.7 for HMM based on sequences of FIGURE 15.
  misc_feature (1)..(273): Functional Homolog Of Ceres ANNOT ID no. 858797 at SEQ ID NO. 342
MGRSPCCEKAHTNKGAWTKEEDERLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPTTHRSINDPTTIPKVTTITFAAAHENIKDIDQQDEMINIKAEFVETSKESDNNEIIQEKSSSCLPDLNLELRISPPHHQQLDHHRHHQRSSSLCFTCSLGIQNSKDCSCGSESNGNGWSNNMVSMNIMAGYDFLGLKTNGLLDYRTLETK

SEQ ID NO: 518 - protein, 274 aa, Lycopersicon chilense
  misc_feature (1)..(274): Public GI ID no.126653935
  misc_feature (1)..(274): Bit score of 344.1 for HMM based on sequences of FIGURE 15.
  misc_feature (13)..(60): Pfam Name: Myb_DNA-binding Pfam Description: Myb-like DNA-binding domain
  misc_feature (1)..(274): Bit score of 344.1 for HMM based on sequences of FIGURE 15.
  misc_feature (1)..(274): Functional Homolog Of Ceres ANNOT ID no. 858797 at SEQ ID NO. 342
MNSTSMSSLGVRKGSWTDEEDFLLRKCIDKYGEGKWHLVPIRAGLNRCRKSCRLRWLNYLRPHIKRGDFEQDEVDLILRLHKLLGNRWSLIAGRLPGRTANDVKNYWNTNLLRKLNTTKIVPREKTNNKCGEISTKIEIIKPQPRKYFSSTMKNITNNIVILDEEEHCKEIKSEKQTPDASMDNVDQWWINLLENCNDDIEEDEEVVINYEKTLTSLLHEEKSPPLNIGEGNSMQQGQISHENWGEFSLNLQPMQQGVQNDDFSAEIDLWNLLD

SEQ ID NO: 519 - protein, 277 aa, Nicotiana tabacum
  misc_feature (1)..(277): Public GI ID no.6552361
  misc_feature (1)..(277): Bit score of 373.7 for HMM based on sequences of FIGURE 15.
  misc_feature (14)..(61): Pfam Name: Myb_DNA-binding Pfam Description: Myb-like DNA-binding domain
  misc_feature (1)..(277): Bit score of 373.7 for HMM based on sequences of FIGURE 15.
  misc_feature (1)..(277): Functional Homolog Of Ceres ANNOT ID no. 858797 at SEQ ID NO. 342
MGRAPCCEKMGLKKGPWTPEEDQILISFIQQNGHGNWRALPKQAGLLRCGKSCRLRWTNYLRPDIKRGNFTKEEEDTIIQLHEMLGNRWSAIAAKLPGRTDNEIKNVWHTHLKKKLKDYKPPQNPKRHSKNHDSKGPTTSESSNNSHLTFIYTQKHIIDSSVPAPNSPQISSSTEMSTVTLVDDHQMVIKQEEMESSEYFPEIDESFWTDKLSTDNNWSNTHDHVMVTADQELQVQLPFSSLKEENVDMLTTKMEDDMDFWYNVFIKTDDLPELPEF

SEQ ID NO: 520 - protein, 278 aa, Nicotiana tabacum
  misc_feature (1)..(278): Public GI ID no.1732247
  misc_feature (1)..(278): Bit score of 349.8 for HMM based on sequences of FIGURE 15.
  misc_feature (67)..(112): Pfam Name: Myb_DNA-binding Pfam Description: Myb-like DNA-binding domain
  misc_feature (1)..(278): Bit score of 349.8 for HMM based on sequences of FIGURE 15.
  misc_feature (1)..(278): Functional Homolog Of Ceres ANNOT ID no. 858797 at SEQ ID NO. 342
MVRAPCCEKMGLKKGPWIPEEDQILISFIQTNGHGNWRALPKQAGLLRCGKSCRLRWTNYLRPDIKRGNFTKEEEETIIQLHEMLGNRWSAIAAKLPGRTDNEIKNVWHTHLKKKLKDYKPPQNSKRHSKSKNHDSKGPTTSESSNNSDLTIINTQKHIDSPVLAPNSPQISSSTEMSTVTLVDDHQMVVIKQEVMESSEYFPEIDESFWTDELTTDNNWSSTDHVMVAANQELQVQLPFSSFKEENVDILATKMEDDMDFWYNVFIKTDDLPELPEF

SEQ ID NO: 521 - protein, 255 aa, Petunia integrifolia
  misc_feature (1)..(255): Public GI ID no.126567773
  misc_feature (1)..(255): Bit score of 333.8 for HMM based on sequences of FIGURE 15.
  misc_feature (13)..(60): Pfam Name: Myb_DNA-binding Pfam Description: Myb-like DNA-binding domain
  misc_feature (1)..(255): Bit score of 333.8 for HMM based on sequences of FIGURE 15.
  misc_feature (1)..(255): Functional Homolog Of Ceres ANNOT ID no. 858797 at SEQ ID NO. 342
MSTSNASTSGVRKGAWTEEEDLLLRECIEKYGEGKWHLVPVRAGLNRCRKSCRLRWLNYLRPHIKRGDFSLDEVDLILRLHKLLGNRWSLIAGRLPGRTANDVKNYWNTHLRKKLIAPHDQKQESKNKAMKITENNIIKPRPRTFSRPAMNHVSCWNGKSCSKNTIDKNEGDTEIIKFSDEKQKPEESIDDGLQWWANLLANNIEIEELVSYNSPTLLHEETAPSVNAESSLTQGGRSGLSDFSVDIDDIWDLLS

SEQ ID NO: 522 - protein, 255 aa, Petunia integrifolia
  misc_feature (1)..(255): Public GI ID no.126567788
  misc_feature (1)..(255): Bit score of 323.1 for HMM based on sequences of FIGURE 15.
  misc_feature (13)..(60): Pfam Name: Myb_DNA-binding Pfam Description: Myb-like DNA-binding domain
  misc_feature (1)..(255): Bit score of 323.1 for HMM based on sequences of FIGURE 15.
  misc_feature (1)..(255): Functional Homolog Of Ceres ANNOT ID no. 858797 at SEQ ID NO. 342
MSTFNASTSGVRKGAWTEEEDLLLRECIEKYGEGKWHLVPVRAGLNRCRKSCRLRWLNYLRPHIKRGDFSLDEVDLILRLHKLLGNRWSLIAGRLPGRTANDVKNYWNTHLRKKLIAPHDQKQESKNKAMKITENNIIKPRPRTFSRPAMNNFSCWNGKSCNKNTIDKNEGDTEIIKLSDENQKREETIDDGLQWWANLLANNIEIEELVSYNSPTLLHEETAPSVNVESSLTQEGGSGLSDFSVDIDDIWDLLG

SEQ ID NO: 523 - protein, 254 aa, Petunia integrifolia
  misc_feature (1)..(254): Public GI ID no.126567775
  misc_feature (1)..(254): Bit score of 334.0 for HMM based on sequences of FIGURE 15.
  misc_feature (13)..(60): Pfam Name: Myb_DNA-binding Pfam Description: Myb-like DNA-binding domain
  misc_feature (1)..(254): Bit score of 334 for HMM based on sequences of FIGURE 15.
  misc_feature (1)..(254): Functional Homolog Of Ceres ANNOT ID no. 858797 at SEQ ID NO. 342
MSTSNASSSGVRKGAWTEEEDLLLRECIEKYGEGKWHLVPVRAGLNRCRKSCRLRWLNYLRPHIKRGDFSLDEVDLILRLHKLLGNRWSLIAGRLPGRTANDVKNYWNTHLRKKLIAPHDQKQESKNKAMKITENNIIKPRPRTFSRPAMNHVSCWNGKSCSKNTIDKNEGDTEIIKFSDEKQKPEESIDDGLQWWANLLANNIEIEELVSYNSPTLLHEETAPSVNAESSLTQGGSGLSDFSVDIDDIWDLLN

SEQ ID NO: 524 - protein, 255 aa, Petunia integrifolia
  misc_feature (1)..(255): Public GI ID no.7673088
  misc_feature (1)..(255): Bit score of 324.5 for HMM based on sequences of FIGURE 15.
  misc_feature (13)..(60): Pfam Name: Myb_DNA-binding Pfam Description: Myb-like DNA-binding domain
  misc_feature (1)..(255): Bit score of 324.5 for HMM based on sequences of FIGURE 15.
  misc_feature (1)..(255): Functional Homolog Of Ceres ANNOT ID no. 858797 at SEQ ID NO. 342
MSTSNASTSGVRKGAWTEEEDLLLRECIEKYGEGKWHLVPVRAGLNRCRKSCRLRWLNYLRPHIKRGDFSLDEVDLILRLHKLLGNRWSLVAGRLPGRTANDVKNYWNTHLRKKLIAPHDQKQESKNKAMKITENNIIKPRPQTFSRPAMNHVSCWNGKSCSKNTIDKNEGDTEIIKFSDEKQKPEESIDDGLQWWANLLANNIEIEELVSCNSPTLLHEETAPSVNAESSLTQGGGSGLSDFSVDIDDIWDLVS

SEQ ID NO: 525 - protein, 255 aa, Petunia integrifolia
  misc_feature (1)..(255): Public GI ID no.126567782
  misc_feature (1)..(255): Bit score of 328.2 for HMM based on sequences of FIGURE 15.
  misc_feature (13)..(60): Pfam Name: Myb_DNA-binding Pfam Description: Myb-like DNA-binding domain
  misc_feature (1)..(255): Bit score of 328.2 for HMM based on sequences of FIGURE 15.
  misc_feature (1)..(255): Functional Homolog Of Ceres ANNOT ID no. 858797 at SEQ ID NO. 342
MSTSNASTSGVRKGAWTEEEDLLLRECIDKYGEGKWHLVPVRAGLNRCRKSCRLRWLNYLRPHIKRGDFSLDEVDLILRLHKLLGNRWSLIAGRLPGRTANDVKNYWNTHLRKKLIAPHDQKQESKNKAMKITENNIIKPRPRTFSRPAMNNFSCWNGKRCNKNTIDKNEGDTEIIKFSDENQKREETIDDGLQWWANLLANNIEIEELVSYNSPTLLHEETAPSVNVESSLTQEGGSGLSDFSVDIDDIWDLLG

SEQ ID NO: 526 - protein, 255 aa, Petunia integrifolia
  misc_feature (1)..(255): Public GI ID no.126567786
  misc_feature (1)..(255): Bit score of 328.3 for HMM based on sequences of FIGURE 15.
  misc_feature (13)..(60): Pfam Name: Myb_DNA-binding Pfam Description: Myb-like DNA-binding domain
  misc_feature (1)..(255): Bit score of 328.3 for HMM based on sequences of FIGURE 15.
  misc_feature (1)..(255): Functional Homolog Of Ceres ANNOT ID no. 858797 at SEQ ID NO. 342
MSTSNASTSGVRKGAWTEEEDLLLRECIDKYGEGKWHLVPVRAGLNRCRKSCRLRWLNYLRPHIKRGDFSLDEVDLILRLHKLLGNRWSLIAGRLPGRTANDVKNYWNTHLRKKLIAPHDQKQESKNKAVKITENNIIKPRPRTFSRPAMNNFSCWNGKSCNKNTIDKNEGDTEIIKFSDEKQKPEESIDDGLQWWANLLANNIEIEELVSCNSPTLLHEETAPSVNAESSLTQEGGSGLSDFSVDIDDIWDLLG

SEQ ID NO: 527 - protein, 255 aa, Petunia integrifolia
  misc_feature (1)..(255): Public GI ID no.126567784
  misc_feature (1)..(255): Bit score of 327.7 for HMM based on sequences of FIGURE 15.
  misc_feature (13)..(60): Pfam Name: Myb_DNA-binding Pfam Description: Myb-like DNA-binding domain
  misc_feature (1)..(255): Bit score of 327.7 for HMM based on sequences of FIGURE 15.
  misc_feature (1)..(255): Functional Homolog Of Ceres ANNOT ID no. 858797 at SEQ ID NO. 342
MSTSNASTSGVRKGAWTEEEDLLLRECIDKYGEGKWHLVPVRAGLNRCRKSCRLRWLNYLRPHIKRGDFSLDEVDLILRLHKLLGNRWSLIAGRLPGRTANDVKNYWNTHLRKKLIAPHDQKQESKNKAVKITENNIIKPRPRTFSRPAMNNFSCWNGKSCNKNTIDKNEGDTEIIKFSDENQKREESIDDGLQWWANLLANNIEIEELVSYNSPTLLHEETAPSVNAESSLTQEGGSGLSDFSVDIDDIWDLLG

SEQ ID NO: 528 - protein, 255 aa, Petunia integrifolia
  misc_feature (1)..(255): Public GI ID no.7673086
  misc_feature (1)..(255): Bit score of 326.1 for HMM based on sequences of FIGURE 15.
  misc_feature (13)..(60): Pfam Name: Myb_DNA-binding Pfam Description: Myb-like DNA-binding domain
  misc_feature (1)..(255): Bit score of 326.1 for HMM based on sequences of FIGURE 15.
  misc_feature (1)..(255): Functional Homolog Of Ceres ANNOT ID no. 858797 at SEQ ID NO. 342
MSTSNASTSGVRKGAWTEEEDLLLRECIEKYGEGKWHLVPVRAGLNRCRKSCRLRWLNYLRPHIKGGDFSLDEVDLILRLHKLLGNRWSLIAGRLPGRTANDVKNYWNTHLRKKLIAPHDQKQESKNKAMKITENSIIKPRPRTFSRPAMNHVSCWNGKSCNKNTIDKNEGDTEIIKFGDEKQKPEESIVDGLQWWANLLANNIEIEELVSYNSPTLLHEETAPSVNAESSLTQEGGSGLSDFSVDIDDIWDLLS

SEQ ID NO: 529 - protein, 271 aa, Solanum tuberosum
  misc_feature (1)..(271): Public GI ID no.61696099
  misc_feature (1)..(271): Bit score of 267.9 for HMM based on sequences of FIGURE 15.
  misc_feature (15)..(62): Pfam Name: Myb_DNA-binding Pfam Description: Myb-like DNA-binding domain
  misc_feature (1)..(271): Bit score of 267.9 for HMM based on sequences of FIGURE 15.
  misc_feature (1)..(271): Functional Homolog Of Ceres ANNOT ID no. 858797 at SEQ ID NO. 342
MSTPMMCTSLGVIRKGSWTEEEDILLRKCIDKYGEGKWHLVPTRTGLNRCRKSCRLRWLNYLRPHIKRGDFDWDEVDLILRLHKLLGNRWSLIAGRLPGRTANDVKNYWNTNLLRKLNTSTKFAPQPQEGINTSTIAPQPQEGINTSTIAPQPQEGIKCGQANAIIRPQPQKFTSSMKINVSWCNNNSIVNNEEASKDNNDMQWWANILENCNDIGEGEAERTLPSCKEINCNEIDKTPSLLHDGGNSMQQGQGDGGWDEFSLDDIWNLLN

SEQ ID NO: 530 - protein, 272 aa, Ipomoea purpurea
  misc_feature (1)..(272): Public GI ID no.66736124
  misc_feature (1)..(272): Bit score of 350.4 for HMM based on sequences of FIGURE 15.
  misc_feature (67)..(112): Pfam Name: Myb_DNA-binding Pfam Description: Myb-like DNA-binding domain
  misc_feature (1)..(272): Bit score of 350.4 for HMM based on sequences of FIGURE 15.
  misc_feature (1)..(272): Functional Homolog Of Ceres ANNOT ID no. 858797 at SEQ ID NO. 342
MVNSSARWSPRVRKGAWSEEEDDLLRKCIQKFGEGKWHLVPFRAGLNRCRKSCRLRWLNYLHPDIKRGHFSLEEADLILRLHKLLGNRWSLIAGRIPGRTANDVKNYWHSHLKKKVVSMHMASSNSSRQDNNWDDEKGKAPQIKENILFRPRPRRFFRTSLSSPALSTLTGKAKAVVYDAPPPPPPPPHQLQPQPEATSPAADLLMVFNVQQNSNSIETNLPAQTTAPSSHDGVKWWEDLLYDDSHQGLIDWTTDDDFPIDVTLLKLLDTTI

SEQ ID NO: 531 - protein, 244 aa, Solenostemon scutellarioides
  misc_feature (1)..(244): Public GI ID no.145306631
  misc_feature (1)..(244): Bit score of 556.5 for HMM based on sequences of FIGURE 15.
  misc_feature (68)..(113): Pfam Name: Myb_DNA-binding Pfam Description: Myb-like DNA-binding domain
  misc_feature (1)..(244): Bit score of 556.5 for HMM based on sequences of FIGURE 15.
  misc_feature (1)..(244): Functional Homolog Of Ceres ANNOT ID no. 858797 at SEQ ID NO. 342
MMGRSPCCEKAHTNKGAWTKEEDDRLISYIRAHGEGCWRSLPKAAGLLRCGKSCRLRWINYLRPDLKRGNFTEDEDELIIKLHSLLGNKWSLIAGRLPGRTDNEIKNYWNTHIRRKLVSQGIDPTTHRPINEPAAAAAAPQEEAVSKTISFSQSERIDKCPDLNLDLRISPPSSSQQQNQEPLKTGTSSGSSSTLCFACSIGIQNSKDCSCRDGIMISVSGSSSGYDFLGLKAGVLDYRSLEMK

SEQ ID NO: 532 - protein, 232 aa, Antirrhinum majus
  misc_feature (1)..(232): Public GI ID no.75107028
  misc_feature (1)..(232): Bit score of 501.3 for HMM based on sequences of FIGURE 15.
  misc_feature (67)..(112): Pfam Name: Myb_DNA-binding Pfam Description: Myb-like DNA-binding domain
  misc_feature (1)..(232): Bit score of 501.3 for HMM based on sequences of FIGURE 15.
  misc_feature (1)..(232): Functional Homolog Of Ceres ANNOT ID no. 858797 at SEQ ID NO. 342
MGRSPCCEKAHTNKGAWTKEEDDRLVAYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPTTHRSINDGTASQDQVTTISFSNANSKEEDTKHKVAVDIMIKEENSPVQERCPDLNLDLKISPPCQQQINYHQENLKTGGRNGSSTLCFVCRLGIQNSKDCSCSDGVGN

SEQ ID NO: 533 - protein, 267 aa, Hordeum vulgare
  misc_feature (1)..(267): Public GI ID no.127579
  misc_feature (1)..(267): Bit score of 509.9 for HMM based on sequences of FIGURE 15.
  misc_feature (67)..(112): Pfam Name: Myb_DNA-binding Pfam Description: Myb-like DNA-binding domain
  misc_feature (1)..(267): Bit score of 509.9 for HMM based on sequences of FIGURE 15.
  misc_feature (1)..(267): Functional Homolog Of Ceres ANNOT ID no. 858797 at SEQ ID NO. 342
MGRSPCCEKAHTNKGAWTKEEDDRLTAYIKAHGEGCWRSLPKAAGLLRCGKSCRLRWINYLRPDLKRGNFSHEEDELIIKLHSLLGNKWSLIAGRLPGRTDNEIKNYWNTHIRRKLTSRGIDPVTHRAINSDHAASNITISFESAQRDDKGAVFRRDAEPAKAAAAAAAISHHVDHHHRSNPQLDWGQGKPLKCPDLNLDLCISPPIHEDPMVDTKPVVKREAGVGVGVVGLCFSCSMGLPRSSDCKCSSFMGLRTAMLDFRSIEMK

SEQ ID NO: 534 - protein, 272 aa, Oryza rufipogon
  misc_feature (1)..(272): Public GI ID no.38707418
  misc_feature (1)..(272): Bit score of 362.1 for HMM based on sequences of FIGURE 15.
  misc_feature (67)..(112): Pfam Name: Myb_DNA-binding Pfam Description: Myb-like DNA-binding domain
  misc_feature (1)..(272): Bit score of 362.1 for HMM based on sequences of FIGURE 15.
  misc_feature (1)..(272): Functional Homolog Of Ceres ANNOT ID no. 858797 at SEQ ID NO. 342
MGRRACCAKEGMKRGAWTSKEDDVLASYIKSHGEGKWREVPQRAGLRRCGKSCRLRWLNYLRPNIKRGNIDDDEEELIVRLHTLLGNRWSLIAGRLPGRTDNEIKNYWNSTLSRKIGTAATAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSSSSLPAVVEPCFSAGDDWMDDVRALATFLDTDDAWNLCA

SEQ ID NO: 535 - protein, 272 aa, Oryza rufipogon
  misc_feature (1)..(272): Public GI ID no.38707422
  misc_feature (1)..(272): Bit score of 353.5 for HMM based on sequences of FIGURE 15.
  misc_feature (67)..(112): Pfam Name: Myb_DNA-binding Pfam Description: Myb-like DNA-binding domain
  misc_feature (1)..(272): Bit score of 353.5 for HMM based on sequences of FIGURE 15.
  misc_feature (1)..(272): Functional Homolog Of Ceres ANNOT ID no. 858797 at SEQ ID NO. 342
MGRRACCAKEGMKRGAWTSKEDDVLASYIKSHGEGKWREVPQRAGLRRCGKSCRLRWLNYLRPNIKRGNIDDDEEELIVRLHTLLGNRWSLIAGRPPGRTDNEIKNYWNSTLSRKIGTAATAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSSSSLPAVVEPCFSAGDDWMDDVRALASFLDTDDAWNLCA

SEQ ID NO: 536 - protein, 239 aa, Oryza sativa
  misc_feature (1)..(239): Public GI ID no.2605617
  misc_feature (1)..(239): Bit score of 400.4 for HMM based on sequences of FIGURE 15.
  misc_feature (67)..(112): Pfam Name: Myb_DNA-binding Pfam Description: Myb-like DNA-binding domain
  misc_feature (1)..(239): Bit score of 400.4 for HMM based on sequences of FIGURE 15.
  misc_feature (1)..(239): Functional Homolog Of Ceres ANNOT ID no. 858797 at SEQ ID NO. 342
MGRSPCCEKAHTNKGAWTKEEDQRLIAYIRAHGEGCWRSLPKAAGLLRCGKSCRLRWMNYLRPDLKRGNFTDDEDELIIRLHSLLGNKWSLIAGQLPGRTDNEIKNYWNTHIKRKLLARGIDPQTHRPLLSGGDGIAASNKRHHRRRIPYPSRRRRRPRRSSPCEAAAAAAPGRLLGRRLPQQQRHNEHGGAAVPRPQPRALGRADAELAAGGDAHQRAAGLPLLPPRLPRRGGVQLSG

SEQ ID NO: 537 - protein, 276 aa, Oryza sativa
  misc_feature (1)..(276): Public GI ID no.2605619
  misc_feature (1)..(276): Bit score of 375.2 for HMM based on sequences of FIGURE 15.
  misc_feature (67)..(112): Pfam Name: Myb_DNA-binding Pfam Description: Myb-like DNA-binding domain
  misc_feature (1)..(276): Bit score of 375.2 for HMM based on sequences of FIGURE 15.
  misc_feature (1)..(276): Functional Homolog Of Ceres ANNOT ID no. 858797 at SEQ ID NO. 342
MGRSPCCEKAHTNKGAWTKEEDQRLIAHINQHGEGCWRSLPKAAGLLRCGKSCRLRWINYLRPDLKRGNFTDEEDELIIKLHELLGNKWSLIAGRLPGRTDNEIKNYWNTHIKRKLLARGLDPLRTARSMPPPPSPATTTSRRRLQLLARRNKRPQQLQRRRRVPRRHRPQPVHKPAVVVVPAVFPAAAAARSRGETRRSDGELHLPPPLLGDEGEDMPVLEPPRAARRRRVQLRRLVGLFLLLAAAGDGELASVHIRQCIVVNSVKHREIQRFSD

SEQ ID NO: 538 - protein, 270 aa, Oryza glaberrima
  misc_feature (1)..(270): Public GI ID no.38707432
  misc_feature (1)..(270): Bit score of 364.2 for HMM based on sequences of FIGURE 15.
  misc_feature (67)..(112): Pfam Name: Myb_DNA-binding Pfam Description: Myb-like DNA-binding domain
  misc_feature (1)..(270): Bit score of 364.2 for HMM based on sequences of FIGURE 15.
  misc_feature (1)..(270): Functional Homolog Of Ceres ANNOT ID no. 858797 at SEQ ID NO. 342
MGRRACCAKEGMKRGAWTSKEDDMLASYIKSHGEGKWREVPQRAGLRRCGKSCRLRWLNYLRPNIKRGNIDDDEEELIVRLHTLLGNRWSLIAGRLPGRTDNEIKNYWNSTLSRKIGTAATAAAGSRGGSTPDTARATDAASSSSVVPPGQQQQPASRADTDTATAAAAATTTTVWAPKAVRCTRGFFFHDRETAPLAAAAPAPAGELGDGDDADCDYYCSGSSSAATTTSSSSFPAVVEPCFSAGDDWMDDVRALASFLDTDDAWNLCA

SEQ ID NO: 539 - protein, 252 aa, Saccharum officinarum
  misc_feature (1)..(252): Public GI ID no.125487106
  misc_feature (1)..(252): Bit score of 459.0 for HMM based on sequences of FIGURE 15.
  misc_feature (67)..(112): Pfam Name: Myb_DNA-binding Pfam Description: Myb-like DNA-binding domain
  misc_feature (1)..(252): Bit score of 459 for HMM based on sequences of FIGURE 15.
  misc_feature (1)..(252): Functional Homolog Of Ceres ANNOT ID no. 858797 at SEQ ID NO. 342
MGRSPCCEKAHTNKGAWTKEEDERLVAYIRAHGEGCWRPLPKAAGLLRCGKSCRLRWMNYLRPDLKRGNFTDDEDELIIRLHSLLGNKWSLIAGQLPGRTDNEIKNYWNTHIKRKLLARGIDPQTHRALGADAATAPGVAAHHRATAAALLHHAGAAVVVVPAPVKLAAVKPAPAESSSDDGGSSSGSSSGGGAGEPRCPDLNLDLSVGPPAVVADTPTLHLAVCLGYRLCLRPGRFAVTMLKLYCVSIWFY

SEQ ID NO: 540 - protein, 265 aa, Triticum aestivum
  misc_feature (1)..(265): Public GI ID no.47680445
  misc_feature (1)..(265): Bit score of 507.9 for HMM based on sequences of FIGURE 15.
  misc_feature (67)..(112): Pfam Name: Myb_DNA-binding Pfam Description: Myb-like DNA-binding domain
  misc_feature (1)..(265): Bit score of 507.9 for HMM based on sequences of FIGURE 15.
  misc_feature (1)..(265): Functional Homolog Of Ceres ANNOT ID no. 858797 at SEQ ID NO. 342
MGRSPCCEKAHTNKGAWTKEEDDRLTAYIKAHGEGCWRSLPKAAGLLRCGKSCRLRWINYLRPDLKRGNFSDEEDELIIKLHSLLGNKWSLIAGRLPGRTDNEIKNYWNTHIRRKLTSRGIDPVTHRAINSDHAASNITISFETAQRDDKGAVFRRDAEPTKVAAAAAAITHVDHHHHHRSNPLHQMEWGQGKPLKCPDLNLDLCISPPSHEDPMVDTKPVVKREAVVGLCFSCSMGLPRSADCKCSSFMGLRTAMLDFRSIEMK

SEQ ID NO: 541 - DNA, 1105 bp, Triticum aestivum
  misc_feature (1)..(1105): Ceres CLONE ID no.764797
  misc_feature (1)..(1105): Encodes the peptide sequence at SEQ ID NO 542
agaaacaggagagagctcgcttcctccctgccctgccctgccctgctctagcaccggcctgagctcgcgcgtggtgttactgctgagtttggccggaatggggcggtcgccgtgctgcgagaaggagcacaccaacaagggggcctggaccaaggaggaggaccagcggctggtcgcctacatcagggccaacggcgagggctgctggcgctcgctgcccaaggcggccggcctgctccgctgcggcaagagctgccgcctgcgctggatgaactacctccgtcccgacctcaagcgcggcaacttcaccgacgacgaggacgagctcatcatccgcctccacagcctcctcggcaacaagtggtctctgatcgccgggcagctgccgggcaggacggacaacgagatcaagaactactggaacacgcacatcaagcgcaagctcctgtcccgcggcatggacccccacacgcaccgcccgctcacggccgtcgacggcggcgcggcatcccgccctgcacacatagcagtgccggcgagggcagcgccacccacgatgttcgccctgccgacaaagcagccgccggtcgtggagtcgtcgtccgacgacggcagcagcggcgcgacgagcacgggggaaccacggtgccccgacctaaacctcgacctgtcggtgggcccgccggcggccgacacgccgacctcgcacccggtctgcctctgccgccacctcggcttccgcggcggggaggcatgcagctgccgtcaggccgacagcccgggctcccaggggggcgggttcagatatttcaggccgttggaggaaggccagtacatatgagacgagacgagacggctaggccctaggctccacagcaatttgcaagacggtgaatttttccacctccacagcaccaccgtctcacaaaacggtgaaaaaaacggtgaaagaatatctaatctgttcatagtatttcaaccatgaatatttgtcctctctgtccctaattttgtatcgttggttggtgctgtgtttggtggaaaaaacgaggggataatgtgacaaaggttggtgtgtgttttttgcgcaaaaaaaaaaaaaaaa

SEQ ID NO: 542 - protein, 247 aa, Triticum aestivum
  misc_feature (1)..(247): Ceres CLONE ID no.764797
  misc_feature (1)..(247): Bit score of 483.0 for HMM based on sequences of FIGURE 15.
  misc_feature (67)..(112): Pfam Name: Myb_DNA-binding Pfam Description: Myb-like DNA-binding domain
  misc_feature (1)..(247): Bit score of 483 for HMM based on sequences of FIGURE 15.
  misc_feature (1)..(247): Functional Homolog Of Ceres ANNOT ID no. 858797 at SEQ ID NO. 342
MGRSPCCEKEHTNKGAWTKEEDQRLVAYIRANGEGCWRSLPKAAGLLRCGKSCRLRWMNYLRPDLKRGNFTDDEDELIIRLHSLLGNKWSLIAGQLPGRTDNEIKNYWNTHIKRKLLSRGMDPHTHRPLTAVDGGAASRPAHIAVPARAAPPTMFALPTKQPPVVESSSDDGSSGATSTGEPRCPDLNLDLSVGPPAADTPTSHPVCLCRHLGFRGGEACSCRQADSPGSQGGGFRYFRPLEEGQYI

SEQ ID NO: 543 - DNA, 933 bp, Zea mays
  misc_feature (1)..(933): Ceres CLONE ID no.1418548
  misc_feature (1)..(933): Encodes the peptide sequence at SEQ ID NO 544
agaagatggggaggtctccttgctgcgagaaggaccacacgaacaaaggagcttggactaaagaagaagacgataagctcgtctcttacatcaaatctcacggcgaaggctgttggcgctctcttccgagatccgccggtcttctccgctgcggcaaaagctgccgtcttcggtggattaactatctccgacctgatctcaagagaggtaacttcaccctcgaagaagacgatctcatcatcaaactccatagcctccttggaaacaaatggtctcttatcgcgacgagattaccggggagaacagataacgagatcaagaactactggaatacacacgtaaagaggaagcttttgagaggagggattgatcccacgactcatcggccgatcaacgaagccaaagctcctcgtgattcgtctgagactagagagacagaggactcgcttgtgaagtttctatctttcagtcgtcaactggagaaaaaggaaagttttggggaagagagaaatgatcagaaaggactgatttgcaaaaaagagagagttgagtattcgattgttgaagaaaagtgcttagatttgaatcttgagcttagaatcagcccgccatggcaagaccaacagcaccatgatgagaccaaactttggtttgggaaagagaagtacatgtgcactgcatgccgttttgggttgggaaacggcaagaagtgtagctgcgataatgttaaatgtcaagtcgagtacagtagtagcagcagcagccattcttcaagcgatattagtagtagcgttattggttatgacttcctgggtttaaagttaaacactagcgttttggattttagtacttcggaaatgaactgaaatgtaatgaaaaatatcaagaaatttattgaaagctgtgatattaacaataaaaaaaaaaaaaaaa

SEQ ID NO: 544 - protein, 286 aa, Zea mays
  misc_feature (1)..(286): Ceres CLONE ID no.1418548
  misc_feature (1)..(286): Bit score of 537.4 for HMM based on sequences of FIGURE 15.
  misc_feature (67)..(112): Pfam Name: Myb_DNA-binding Pfam Description: Myb-like DNA-binding domain
  misc_feature (1)..(286): Bit score of 537.4 for HMM based on sequences of FIGURE 15.
  misc_feature (1)..(286): Functional Homolog Of Ceres ANNOT ID no. 858797 at SEQ ID NO. 342
MGRSPCCEKDHTNKGAWTKEEDDKLVSYIKSHGEGCWRSLPRSAGLLRCGKSCRLRWINYLRPDLKRGNFTLEEDDLIIKLHSLLGNKWSLIATRLPGRTDNEIKNYWNTHVKRKLLRGGIDPTTHRPINEAKAPRDSSETRETEDSLVKFLSFSRQLEKKESFGEERNDQKGLICKKERVEYSIVEEKCLDLNLELRISPPWQDQQHHDETKLWFGKEKYMCTACRFGLGNGKKCSCDNVKCQVEYSSSSSSHSSSDISSSVIGYDFLGLKLNTSVLDFSTSEMN

SEQ ID NO: 545 - protein, 226 aa, Zea mays
  misc_feature (1)..(226): Public GI ID no.89143143
  misc_feature (1)..(226): Bit score of 399.7 for HMM based on sequences of FIGURE 15.
  misc_feature (67)..(112): Pfam Name: Myb_DNA-binding Pfam Description: Myb-like DNA-binding domain
  misc_feature (1)..(226): Bit score of 399.7 for HMM based on sequences of FIGURE 15.
  misc_feature (1)..(226): Functional Homolog Of Ceres ANNOT ID no. 858797 at SEQ ID NO. 342
MGRSPCCEKAHTNKGAWTKEEDQRLVAYIKAHGEGCWRSLPKAAGLLRCGKSCRLRWINYLRPDLKRGNFTQEEDDVIIKLHQVLGNKWSLIAAQLPGRTDNEIKNYWNTHIKRKLIARGIDPRTHQPASAAAVAPAAAAAAAAQSSFRHHGDDEAVARRSCSRDSGCIAAHSSDDDDSTSGSLPHQHAVGGIDLNLSLSPPTSQPSSPAAAKGVVASGYGQGSES

SEQ ID NO: 546 - protein, 198 aa, Gossypium arboreum
  misc_feature (1)..(198): Public GI ID no.51872289
  misc_feature (1)..(198): Bit score of 297.6 for HMM based on sequences of FIGURE 15.
  misc_feature (15)..(62): Pfam Name: Myb_DNA-binding Pfam Description: Myb-like DNA-binding domain
  misc_feature (1)..(198): Bit score of 297.6 for HMM based on sequences of FIGURE 15.
  misc_feature (1)..(198): Functional Homolog Of Ceres ANNOT ID no. 858797 at SEQ ID NO. 342
MAPKKDGVSKRVFNKGSWTAEEDRRLAKYIEIHGAKRWKTIAIKSGLNRCGKSCRLRWLNYLRPNIKRGNISDEEEDLIIRLHKLLGNRWSLIAGRLPGRTDNEIKNYWNSHLSKKIINHDVRTEQTSSSEQIVPHKAWETVQMEEEEVVKGSDEIENSEFSIDVDEFFDFTTEGCFSLDWVNKFLELDDQQDPLAMV

SEQ ID NO: 547 - protein, 251 aa, Vitis vinifera
  misc_feature (1)..(251): Public GI ID no.119220854
  misc_feature (1)..(251): Bit score of 554.7 for HMM based on sequences of FIGURE 15.
  misc_feature (67)..(112): Pfam Name: Myb_DNA-binding Pfam Description: Myb-like DNA-binding domain
  misc_feature (1)..(251): Bit score of 554.7 for HMM based on sequences of FIGURE 15.
  misc_feature (1)..(251): Functional Homolog Of Ceres ANNOT ID no. 858797 at SEQ ID NO. 342
MGRSPCCEKAHTNKGAWTKEEDDRLIAYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPSTHRPINEPSPDVTTISFAAAVKEEEKINISSTGGFGCKTEKNPVTEKCPDLNLELRISPPYQPQAETPLKTGGRSSSTTLCFACSLGIPNSEECSCSIGTSSGSSSSGYDFLGLTSGVLDYRGLEMK

SEQ ID NO: 548 - protein, 261 aa, Ipomoea nil
  misc_feature (1)..(261): Public GI ID no.101919348
  misc_feature (1)..(261): Bit score of 377.2 for HMM based on sequences of FIGURE 15.
  misc_feature (19)..(66): Pfam Name: Myb_DNA-binding Pfam Description: Myb-like DNA-binding domain
  misc_feature (1)..(261): Bit score of 377.2 for HMM based on sequences of FIGURE 15.
  misc_feature (1)..(261): Functional Homolog Of Ceres ANNOT ID no. 858797 at SEQ ID NO. 342
MVNSSSAWPPPSSSRLMRKGAWTEEEDNLLRKCIQKYGEGKWHLVPLRAGLNRCRKSCRLRWLNYLRPDIKRGDFSVDEVDLIMRLHRLLGNRWSLIAGRIPGRTANDVKNYWNTHIQKKVFAMARMQDNWKGKAPEIRENTVVRPRPRRFLNTSLSPTSKTGKATAVTYDAQIQGHTLPQPPEAIITTSDLVMENVQLNNTIATLPSELETTTSDDRVRWWEDLLFDKEFNDDEGNACMHEGQVGWTNLPIDMDLLELLS

SEQ ID NO: 549 - protein, 222 aa, Oryza sativa subsp. indica
  misc_feature (1)..(222): Public GI ID no.125562458
  misc_feature (1)..(222): Bit score of 460.9 for HMM based on sequences of FIGURE 15.
  misc_feature (67)..(112): Pfam Name: Myb_DNA-binding Pfam Description: Myb-like DNA-binding domain
  misc_feature (1)..(222): Bit score of 460.9 for HMM based on sequences of FIGURE 15.
  misc_feature (1)..(222): Functional Homolog Of Ceres ANNOT ID no. 858797 at SEQ ID NO. 342
MGRSPCCEKEHTNKGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKLLGRGIDPVTHRPVNAAAATISFHPQPPPTTKEEQLILSKPPKCPDLNLDLCISPPSCQEEDDDYEAKPAMIFKEILLFRVYTSVLNVKKKSERICSLMLTRASVVP

SEQ ID NO: 550 - protein, 243 aa, Oryza sativa subsp. indica
  misc_feature (1)..(243): Public GI ID no.125562456
  misc_feature (1)..(243): Bit score of 504.3 for HMM based on sequences of FIGURE 15.
  misc_feature (67)..(112): Pfam Name: Myb_DNA-binding Pfam Description: Myb-like DNA-binding domain
  misc_feature (1)..(243): Bit score of 504.3 for HMM based on sequences of FIGURE 15.
  misc_feature (1)..(243): Functional Homolog Of Ceres ANNOT ID no. 858797 at SEQ ID NO. 342
MGRSPCCEKEHTNKGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKLLGRGIDPVTHRPVNAAAATISFHPQPPPTTKEEQLILSKPPKCPDLNLDLCISPPSCQEEDDDYEAKPAMIVRATELQRRRGGLCFGCSLGLQKECKCSGGGGGAGAGNNFLGLRAGMLDFRSLPMK

SEQ ID NO: 551 - protein, 301 aa, Oryza sativa subsp. indica
  misc_feature (1)..(301): Public GI ID no.125533629
  misc_feature (1)..(301): Bit score of 429.0 for HMM based on sequences of FIGURE 15.
  misc_feature (67)..(112): Pfam Name: Myb_DNA-binding Pfam Description: Myb-like DNA-binding domain
  misc_feature (1)..(301): Bit score of 429 for HMM based on sequences of FIGURE 15.
  misc_feature (1)..(301): Functional Homolog Of Ceres ANNOT ID no. 858797 at SEQ ID NO. 342
MGRSPCCEKAHTNKGAWTKEEDQRLIAYIKANGEGCWRSLPKAAGLLRCGKSCRLRWINYLRPDLKRGNFTEEEDELIIKLHELLGNKWSLIAGRLPGRTDNEIKNYWNTHIKRKLLARGVDPQTHRPLNAAADHHQQQQLQAPRRFAAAPAGHHHHHPDHFAVLSNSPEACSHSSDDEPSSATPPPPPRHLGIDLNLSISLAPYQPQDQTSEPMKQEEDDEASATANGAGNAAMTTTATTAAVCLCLNRLGLHGGEMREVRSEWYILMKVKEGARCGCGAAGGYGKLGFLMNVCNHMSSQ

SEQ ID NO: 552 - protein, 229 aa, Oryza sativa subsp. japonica
  misc_feature (1)..(229): Public GI ID no.19072766
  misc_feature (1)..(229): Bit score of 478.8 for HMM based on sequences of FIGURE 15.
  misc_feature (67)..(112): Pfam Name: Myb_DNA-binding Pfam Description: Myb-like DNA-binding domain
  misc_feature (1)..(229): Bit score of 478.8 for HMM based on sequences of FIGURE 15.
  misc_feature (1)..(229): Functional Homolog Of Ceres ANNOT ID no. 858797 at SEQ ID NO. 342
MGRSPCCEKEHTNKGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKLLGRGIDPVTHRPVNAAAATISFHPQPPPTTKEEQLILSKPPKCPDLNLDLCISPPSCQEEDDDYEAKPAMIVRAPELQRRRGGLCFGCSLGLQKECKCSGGGAGAGAGNNFLG

SEQ ID NO: 553 - protein, 243 aa, Oryza sativa subsp. japonica
  misc_feature (1)..(243): Public GI ID no.115477685
  misc_feature (1)..(243): Bit score of 504.7 for HMM based on sequences of FIGURE 15.
  misc_feature (67)..(112): Pfam Name: Myb_DNA-binding Pfam Description: Myb-like DNA-binding domain
  misc_feature (1)..(243): Bit score of 504.7 for HMM based on sequences of FIGURE 15.
  misc_feature (1)..(243): Functional Homolog Of Ceres ANNOT ID no. 858797 at SEQ ID NO. 342
MGRSPCCEKEHTNKGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKLLGRGIDPVTHRPVNAAAATISFHPQPPPTTKEEQLILSKPPKCPDLNLDLCISPPSCQEEDDDYEAKPAMIVRAPELQRRRGGLCFGCSLGLQKECKCSGGGAGAGAGNNFLGLRAGMLDFRSLPMK

SEQ ID NO: 554 - protein, 295 aa, Oryza sativa subsp. japonica
  misc_feature (1)..(295): Public GI ID no.115484469
  misc_feature (1)..(295): Bit score of 427.9 for HMM based on sequences of FIGURE 15.
  misc_feature (67)..(112): Pfam Name: Myb_DNA-binding Pfam Description: Myb-like DNA-binding domain
  misc_feature (1)..(295): Bit score of 427.9 for HMM based on sequences of FIGURE 15.
  misc_feature (1)..(295): Functional Homolog Of Ceres ANNOT ID no. 858797 at SEQ ID NO. 342
MGRSPCCEKAHTNKGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKLLARGVDPQTHRPLNAAADHHQQQQLQAPRRFAAAPAGHHHHHPDHFAVLSNSPEACSHSSDDEPSSATPPPPPRHLGIDLNLSISLAPYQPQDQTSEPMKQEEDDEASATANGAGNAAMTTTATTAAVCLCLNRLGLHGGEVCSCGRGGAPSMQASTHMFRFITPLGGSHHNSSSTTMT

SEQ ID NO: 555 - protein, 260 aa, Oryza sativa subsp. japonica
  misc_feature (1)..(260): Public GI ID no.125594329
  misc_feature (1)..(260): Bit score of 471.8 for HMM based on sequences of FIGURE 15.
  misc_feature (67)..(112): Pfam Name: Myb_DNA-binding Pfam Description: Myb-like DNA-binding domain
  misc_feature (1)..(260): Bit score of 471.8 for HMM based on sequences of FIGURE 15.
  misc_feature (1)..(260): Functional Homolog Of Ceres ANNOT ID no. 858797 at SEQ ID NO. 342
MGRSPCCEKAHTNKGAWTKEEDQRLIAYIRAHGEGCWRSLPKAAGLLRCGKSCRLRWMNYLRPDLKRGNFTDDEDELIIRLHSLLGNKWSLIAGQLPGRTDNEIKNYWNTHIKRKLLARGIDPQTHRPLLSGGDGIAASNKAAPPPPHPISVPAKAAAAAIFAVAKPQQPPRPVDSSDDGCRSSSGTTSTGEPRCPDLNLELSVGPTPSSPPAETPTSARPVCLCYHLGFRGGEACSCQADSKGPHEFRYFRPLEQGQYI

SEQ ID NO: 556 - protein, 260 aa, Oryza sativa subsp. japonica
  misc_feature (1)..(260): Public GI ID no.55733916
  misc_feature (1)..(260): Bit score of 472.0 for HMM based on sequences of FIGURE 15.
  misc_feature (67)..(112): Pfam Name: Myb_DNA-binding Pfam Description: Myb-like DNA-binding domain
  misc_feature (1)..(260): Bit score of 472 for HMM based on sequences of FIGURE 15.
  misc_feature (1)..(260): Functional Homolog Of Ceres ANNOT ID no. 858797 at SEQ ID NO. 342
MGRSPCCEKAHTNKGAWTKEEDQRLIAYIRAHGEGCWRSLPKAAGLLRCGKSCRLRWMNYLRPDLKRGNFTDDEDELIIRLHSLLGNKWSLIAGQLPGRTDNEIKNYWNTHIKRKLLARGIDPQTHRPLLSGGDGIAASNKAAPPPPHPISVPAKAAAAAIFAVAKPPPPPRPVDSSDDGCRSSSGTTSTGEPRCPDLNLELSVGPTPSSPPAETPTSARPVCLCYHLGFRGGEACSCQADSKGPHEFRYFRPLEQGQYI

SEQ ID NO: 557 - protein, 261 aa, Oryza sativa subsp. japonica
  misc_feature (1)..(261): Public GI ID no.125576429
  misc_feature (1)..(261): Bit score of 416.8 for HMM based on sequences of FIGURE 15.
  misc_feature (67)..(112): Pfam Name: Myb_DNA-binding Pfam Description: Myb-like DNA-binding domain
  misc_feature (1)..(261): Bit score of 416.8 for HMM based on sequences of FIGURE 15.
  misc_feature (1)..(261): Functional Homolog Of Ceres ANNOT ID no. 858797 at SEQ ID NO. 342
MGRSPCCEKAHTNKGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKLLARGVDPQTHRPLNAAADHHQQQQLQAPRRFAAAPAGHHHHHPDHFAVLSNSPEACSHSSDDEPSSATPPPPPRHLGIDLNLSISLAPYQPQDQTSEPMKQEEDDEASATANGAGNAAMTTTATTAAVCLCLNRLGLHGGEPRPE

SEQ ID NO: 558 - protein, 287 aa, Oryza sativa subsp. japonica
  misc_feature (1)..(287): Public GI ID no.115441355
  misc_feature (1)..(287): Bit score of 457.2 for HMM based on sequences of FIGURE 15.
  misc_feature (67)..(112): Pfam Name: Myb_DNA-binding Pfam Description: Myb-like DNA-binding domain
  misc_feature (1)..(287): Bit score of 457.2 for HMM based on sequences of FIGURE 15.
  misc_feature (1)..(287): Functional Homolog Of Ceres ANNOT ID no. 858797 at SEQ ID NO. 342
MGRSPCCEKAHTNKGAWTKEEDQRLIAYIKAHGEGCWRSLPKAAGLLRCGKSCRLRWMNYLRPDLKRGNFTDDDDELIIKLHALLGNKWSLIAGQLPGRTDNEIKNYWNTHIKRKLLSRGIDPQTHRPVSAGSSAAAASGLTTTASTAAFPSLAPAPPPQQHRLHNPVHAAAPSNASFARSAASPPSEDGHSSSGGSSDAPRCPDLNLDLDLDLSMSLPSSPPKTPAAASSTTASRHHHHQQQKTICLCYHLGVRNGDVCSCKAAAPSPAGPRAFRFLRPLEEGQYI

SEQ ID NO: 559 - protein, 266 aa, Oryza sativa subsp. japonica
  misc_feature (1)..(266): Public GI ID no.77553801
  misc_feature (1)..(266): Bit score of 433.0 for HMM based on sequences of FIGURE 15.
  misc_feature (67)..(112): Pfam Name: Myb_DNA-binding Pfam Description: Myb-like DNA-binding domain
  misc_feature (1)..(266): Bit score of 433 for HMM based on sequences of FIGURE 15.
  misc_feature (1)..(266): Functional Homolog Of Ceres ANNOT ID no. 858797 at SEQ ID NO. 342
MGRSPCCEKAHTNKGAWTKEEDQRLIAHINQHGEGCWRSLPKAAGLLRCGKSCRLRWINYLRPDLKRGNFTDEEDELIIKLHELLGNKWSLIAGRLPGRTDNEIKNYWNTHIKRKLLARGLDPLTHRPLNAAAAVAGHHHLAAGGSSCSPDATSGHSSCSDGDEYRGGIDLNLSISPPSSSSQPSSPPPPPHEAEARRAGATASYTYHHHYSETREKICLCLNHLGLHGGDECSCGGSSASSSSSPPPATASSRAFTFANASSSTV

SEQ ID NO: 560 - protein, 223 aa, Arabidopsis lyrata
  misc_feature (1)..(223): Public GI ID no.76789657
  misc_feature (1)..(223): Bit score of 309.2 for HMM based on sequences of FIGURE 15.
  misc_feature (69)..(114): Pfam Name: Myb_DNA-binding Pfam Description: Myb-like DNA-binding domain
  misc_feature (1)..(223): Bit score of 309.2 for HMM based on sequences of FIGURE 15.
  misc_feature (1)..(223): Functional Homolog Of Ceres ANNOT ID no. 858797 at SEQ ID NO. 342
MRIRRREEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKKLVGDYSSAVKTTGEDDDSLPSLFITAATTSCHHQQENVYENIAKRFDGVVSASYEDKPKQELAQNDVLMATTNDPSHYYGNNALWVHDDDFELSSLFTRNDEFCFW

SEQ ID NO: 561 - protein, 224 aa, Arabidopsis lyrata
  misc_feature (1)..(224): Public GI ID no.89258177
  misc_feature (1)..(224): Bit score of 311.3 for HMM based on sequences of FIGURE 15.
  misc_feature (69)..(114): Pfam Name: Myb_DNA-binding Pfam Description: Myb-like DNA-binding domain
  misc_feature (1)..(224): Bit score of 311.3 for HMM based on sequences of FIGURE 15.
  misc_feature (1)..(224): Functional Homolog Of Ceres ANNOT ID no. 858797 at SEQ ID NO. 342
MRIRRREEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKKLVGDYSSAVKTTGEDDDSLPSLFITAATTSSRHHQQENVYENIAKSFDGVVSASYEDKPKQELAQNDVLMATTNDPSHYYGNNALWVHDDDFELSSLFTRNDEFCFW

SEQ ID NO: 562 - protein, 223 aa, Arabidopsis lyrata
  misc_feature (1)..(223): Public GI ID no.89258179
  misc_feature (1)..(223): Bit score of 300.6 for HMM based on sequences of FIGURE 15.
  misc_feature (69)..(114): Pfam Name: Myb_DNA-binding Pfam Description: Myb-like DNA-binding domain
  misc_feature (1)..(223): Bit score of 300.6 for HMM based on sequences of FIGURE 15.
  misc_feature (1)..(223): Functional Homolog Of Ceres ANNOT ID no. 858797 at SEQ ID NO. 342
MRIRRREEKENQEYKKGLWTVEEDNILMDYVLNHGTGQWNRIVRKTGLKRCGKSCRLRWMNYLSPNVNKGNFTEQEEDLIIRLHKLLGNRWSLIDKRVPGRTDNQVKNYWNTHLSKKLVGDYSSAVKTTGEDDDSLPSLFITAATTSCHHQQENVYENIAKSFDGVVSASYEDKPKQELAQNDVLMATTNDPSHYYGNNALWVHDDDFELSSLFTRNDEFCFW

SEQ ID NO: 563 - protein, 228 aa, Arabidopsis lyrata subsp. kamchatica
  misc_feature (1)..(228): Public GI ID no.41581480
  misc_feature (1)..(228): Bit score of 311.6 for HMM based on sequences of FIGURE 15.
  misc_feature (69)..(114): Pfam Name: Myb_DNA-binding Pfam Description: Myb-like DNA-binding domain
  misc_feature (1)..(228): Bit score of 311.6 for HMM based on sequences of FIGURE 15.
  misc_feature (1)..(228): Functional Homolog Of Ceres ANNOT ID no. 858797 at SEQ ID NO. 342
MRIRRREEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKKLVGDYSSAVKTTGGNDDSLPSLFITAATTSSRHHQQENVYENIAKSFDGVVSASYEDKPKQELAQNDVLMATTNDPSHYYGNNALWVHDDDFELSSLVMMNFGSGDIEYCL

SEQ ID NO: 564 - protein, 294 aa, Brassica rapa subsp. chinensis
  misc_feature (1)..(294): Public GI ID no.148524147
  misc_feature (1)..(294): Bit score of 540.3 for HMM based on sequences of FIGURE 15.
  misc_feature (67)..(112): Pfam Name: Myb_DNA-binding Pfam Description: Myb-like DNA-binding domain
  misc_feature (1)..(294): Bit score of 540.3 for HMM based on sequences of FIGURE 15.
  misc_feature (1)..(294): Functional Homolog Of Ceres ANNOT ID no. 858797 at SEQ ID NO. 342
MGRSPCCEKAHTNKGAWTKEEDERLIAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTTHRPIQESSASQDSKPTHLEAITSNTINISFASSSSTPKMEIFQESTSFPGKQEKISMVTFKEEKDECPVEENFPDLNLELRISLPDVVDHHHQGFVGEGKTTTPRRCFKCSLGTINGMECRCGRMRCDVVGGSKGSGKGSDMSNGFDFLGLAKKETNTCLFGFRSLEMK

SEQ ID NO: 565 - protein, 253 aa, Vitis labrusca x Vitis vinifera
  misc_feature (1)..(253): Public GI ID no.22266673
  misc_feature (1)..(253): Bit score of 372.4 for HMM based on sequences of FIGURE 15.
  misc_feature (14)..(61): Pfam Name: Myb_DNA-binding Pfam Description: Myb-like DNA-binding domain
  misc_feature (1)..(253): Bit score of 372.4 for HMM based on sequences of FIGURE 15.
  misc_feature (1)..(253): Functional Homolog Of Ceres ANNOT ID no. 858797 at SEQ ID NO. 342
MVRAPCCDKVGLKKGPWTTQEDQNLTAYVLQHGHGNWRALPKQAGLLRCGKSCRLRWINYLRPDIKRGNFSREEEDTIIELHEKLGNKWSAIAASLPGRTDNEIKNVWHTHLKKRLKKKLATPDSKGHFTPAASACDSDSFNSSGKMSPQPSSSEFSSFTDSSTRTMETHSTGVKNEQMEEYSPESFPEIDESFWSDALSSDNSSMASDFPAVADELQLQTPELACGQISNMMDDGMEFWYDVFIRAGGLQEL

SEQ ID NO: 566 - protein, 253 aa, Vitis labrusca x Vitis vinifera
  misc_feature (1)..(253): Public GI ID no.22266675
  misc_feature (1)..(253): Bit score of 367.1 for HMM based on sequences of FIGURE 15.
  misc_feature (14)..(61): Pfam Name: Myb_DNA-binding Pfam Description: Myb-like DNA-binding domain
  misc_feature (1)..(253): Bit score of 367.1 for HMM based on sequences of FIGURE 15.
  misc_feature (1)..(253): Functional Homolog Of Ceres ANNOT ID no. 858797 at SEQ ID NO. 342
MVRAPCCDKVGLKKGPWTTQEDQILTAYVLQHGHGNWRALPKQAGLLRCGKSCRLRWINYLRPDIKRGNFSREEEDTIIELHEKLGNKWSAIAASLPGRTDNEIKNVWHTHLKKRLTKKLATPDSKGHFTAAASTCDSDSFNSSGKMSPQPSSSEFSSFTDSSTRTMETHSTGVKNEQMEEYSPESFPEIDESFWSDALSSDNSSMASDFPAVADELQLQTPELAYGQISNMMDDGMEFWYDVFIRAGGLQEL

SEQ ID NO: 567 - protein, 251 aa, Hordeum vulgare subsp. vulgare
  misc_feature (1)..(251): Public GI ID no.19055
  misc_feature (1)..(251): Bit score of 489.5 for HMM based on sequences of FIGURE 15.
  misc_feature (67)..(112): Pfam Name: Myb_DNA-binding Pfam Description: Myb-like DNA-binding domain
  misc_feature (1)..(251): Bit score of 489.5 for HMM based on sequences of FIGURE 15.
  misc_feature (1)..(251): Functional Homolog Of Ceres ANNOT ID no. 858797 at SEQ ID NO. 342
MGRSPCCEKEHTNKGAWTKEEDQRLIAYIRANGEGCWRSLPKAAGLLRCGKSCRLRWMNYLRPDLKRGNFTDDEDELIIRLHSLLGNKWSLIAGQLPGRTDNEIKNYWNTHIKRKLLSRGMDPHTHRPLTAVIDAAAPTRPAQIAVPARAAPTTMFALPTKQQQPPVPVESSDDDGSSGATSTGEPRCPDLNLDLSVGPPAADTPTSHPVCLCRHLGFRGGEACSCRQADSAGSQGGGFRYFRPLEEGQYI

SEQ ID NO: 568 - protein, 256 aa, Saussurea medusa
  misc_feature (1)..(256): Public GI ID no.23307803
  misc_feature (1)..(256): Bit score of 339.0 for HMM based on sequences of FIGURE 15.
  misc_feature (67)..(112): Pfam Name: Myb_DNA-binding Pfam Description: Myb-like DNA-binding domain
  misc_feature (1)..(256): Bit score of 339 for HMM based on sequences of FIGURE 15.
  misc_feature (1)..(256): Functional Homolog Of Ceres ANNOT ID no. 858797 at SEQ ID NO. 342
MVRAPCFDKHGIKRGAWSQEEDNKLRAHIQRSGHSNWRQLPKLAGLSRCGKSCRLRWVNYLRPTIKHGNFTKDEKDVVVALHNKLGNKWSAIAARLPGRSDNEIKNYWHTHLKNRAQTDQTVLQTKQDGNAETSKGKGTPKAGCVVRKPNVKSQQEVEILLAVLSSASSSSFSSSTTSDQNESSPPSLSVSDANVTPQCSEEAARSLCIDQFLVEEDSIMLSSDKMYSPLGSVDYFISQDNVMDDVLLWPNLDFYY

SEQ ID NO: 569 - protein, 255 aa, Petunia integrifolia subsp. inflata
  misc_feature (1)..(255): Public GI ID no.126567771
  misc_feature (1)..(255): Bit score of 334.2 for HMM based on sequences of FIGURE 15.
  misc_feature (13)..(60): Pfam Name: Myb_DNA-binding Pfam Description: Myb-like DNA-binding domain
  misc_feature (1)..(255): Bit score of 334.2 for HMM based on sequences of FIGURE 15.
  misc_feature (1)..(255): Functional Homolog Of Ceres ANNOT ID no. 858797 at SEQ ID NO. 342
MSTSNASTSGVRKGAWTEEEDLLLRECIEKYGEGKWHLVPVRAGLNRCRKSCRLRWLNYLRPHIKRGDFSLDEVDLILRLHKLLGNRWSLIAGRLPGRTANDVKNYWNTHLRKKLIAPHDQKQESKNKAMKITENNIIKPRPRTFSRPAMNHVSCWNGKSCSKNTIDKNEGDTEIIKFSDEKQKPEESIDDGLQWWANLLANNIEIEELVSYNSPTLLHEETAPSVNAESSLTQEGGSGLSDFSVDIDDIWDLLS

SEQ ID NO: 570 - protein, 216 aa, Dendrobium sp. XMW-2002-8
  misc_feature (1)..(216): Public GI ID no.28628961
  misc_feature (1)..(216): Bit score of 452.2 for HMM based on sequences of FIGURE 15.
  misc_feature (67)..(112): Pfam Name: Myb_DNA-binding Pfam Description: Myb-like DNA-binding domain
  misc_feature (1)..(216): Bit score of 452.2 for HMM based on sequences of FIGURE 15.
  misc_feature (1)..(216): Functional Homolog Of Ceres ANNOT ID no. 858797 at SEQ ID NO. 342
MGRSPCCEKAHTNKGAWTKEEDERLVAYIKVHGEGCWRSLPKAAGLLRCGKSCRLRWINYLRPDLKRGNFTEEEDELIIKLHSLLGNKWSLIAGRLQGRTDNEIKNYWNTHIRRKLLSRGIDPTTHRPLHGQADASFVNEVEKVVSFRRREDENKSSNSSSSNSRSNSEEAKRWRCPDLNLELCISPPLQKQEDSEEDMMREEFGLCFTNGLLEFR

SEQ ID NO: 571 - protein, 248 aa, Anthurium andraeanum
  misc_feature (1)..(248): Public GI ID no.29824962
  misc_feature (1)..(248): Bit score of 324.7 for HMM based on sequences of FIGURE 15.
  misc_feature (27)..(74): Pfam Name: Myb_DNA-binding Pfam Description: Myb-like DNA-binding domain
  misc_feature (1)..(248): Bit score of 324.7 for HMM based on sequences of FIGURE 15.
  misc_feature (1)..(248): Functional Homolog Of Ceres ANNOT ID no. 858797 at SEQ ID NO. 342
MTAKAKRGAAVAAEARVAKKRVVKLNKGPWTAEEDQKLVEYVDAHGDRKWTSLPTKAGLNRCGKSCRLRWLNYLRPGIKRGNISEAEEDMIIRLHNLIGNRWSLIAGRLPGRTDNEIKNYWNTHLSKKPLTISDLNDKLNDDGGSRSDVDEPPSSGQSQGPLDSRRPAEPRISEASNEVAFNVDELVNLPAILDFDDLLDSGSCSDGIITSSQIFWTPNFSAHDQQDISDFDDLGMLMDIMDYVICPP

SEQ ID NO: 572 - protein, 268 aa, Tradescantia fluminensis
  misc_feature (1)..(268): Public GI ID no.42541177
  misc_feature (1)..(268): Bit score of 480.0 for HMM based on sequences of FIGURE 15.
  misc_feature (67)..(112): Pfam Name: Myb_DNA-binding Pfam Description: Myb-like DNA-binding domain
  misc_feature (1)..(268): Bit score of 480 for HMM based on sequences of FIGURE 15.
  misc_feature (1)..(268): Functional Homolog Of Ceres ANNOT ID no. 858797 at SEQ ID NO. 342
MGRSPCCEKAHTNKGAWTKEEDQRLIAYIKVHGEGCWRSLPKAAGLLRCGKSCRLRWINYLRPDLKRGNFTEEEDELIIKLHALLGNKWSLIAGRLPGRTDNEIKNYWNTHIKRKLISRGIDPQTHRPINAGSQFTISSANHQGSLKNIRDNEALKQSPNSSSQDMQSNSSVIDVVERCPDLNLDIAINIAYSTDQKPFSSSTEVQKAPAVTQATTPTSVSPYFQPICLCYNLGFSKSEACSCRASSNDNQHVLRYYRPLIEEGHQTN

SEQ ID NO: 573 - protein, 270 aa, Tradescantia fluminensis
  misc_feature (1)..(270): Public GI ID no.42541167
  misc_feature (1)..(270): Bit score of 470.4 for HMM based on sequences of FIGURE 15.
  misc_feature (67)..(112): Pfam Name: Myb_DNA-binding Pfam Description: Myb-like DNA-binding domain
  misc_feature (1)..(270): Bit score of 470.4 for HMM based on sequences of FIGURE 15.
  misc_feature (1)..(270): Functional Homolog Of Ceres ANNOT ID no. 858797 at SEQ ID NO. 342
MGRSPCCEKAHTNKGAWTKEEDQRLIAYIKVHGEGCWRSLPKSAGLLRCGKSCRLRWINYLRPDLKRGNFTEEEDEVIIKLHALLGNKWSLIAGRLPGRTDNEIKNYWNTHIKRKLISRGIDPQTHRPVNSGAQFTISSANNQANSTKIPVNEALKQSTDSSSSQDMQSSNSVLDVVERCPDLNLDLSINIAYSTDRKPFSSSTEMQITPAATEATTPTSVSPYFQPICLCYRLGFSRTEACSCKAISNSNSQNVFRYYRPLKEEGHQTN

SEQ ID NO: 574 - protein, 294 aa, Brassica rapa var. purpuraria
  misc_feature (1)..(294): Public GI ID no.148524145
  misc_feature (1)..(294): Bit score of 538.6 for HMM based on sequences of FIGURE 15.
  misc_feature (67)..(112): Pfam Name: Myb_DNA-binding Pfam Description: Myb-like DNA-binding domain
  misc_feature (1)..(294): Bit score of 538.6 for HMM based on sequences of FIGURE 15.
  misc_feature (1)..(294): Functional Homolog Of Ceres ANNOT ID no. 858797 at SEQ ID NO. 342
MGRSPCCEKAHTNKGAWTKEEDERLIAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTTHRPIQESSASQDSKPTHLEAITSNTINISFASSSSTPKMEIFQESTSFPGKQEKISMVTFKEEKDECPVEENFPDLNLELRISLPDVVDHHHQGFVGEGKTTTPRRCFKCSLGTINGMECRCGRMRYDVVGGSKGSGKGSDMSNGFDFLGLAKKETNTCLFGFRSLEMK

SEQ ID NO: 575 - protein, 364 aa, Picea abies; identical to SEQ ID NO: 378
  misc_feature (1)..(364): Public GI ID no.56605372
  misc_feature (1)..(364): Bit score of 926.7 for HMM based on sequences of FIGURE 16.
  misc_feature (34)..(85): Pfam Name: Dimerisation Pfam Description: Dimerisation domain
  misc_feature (95)..(340): Pfam Name: Methyltransf_2 Pfam Description: O-methyltransferase
  misc_feature (95)..(340): Pfam Name: Methyltransf_2 Pfam Description: O-methyltransferase
  misc_feature (1)..(364): Bit score of 926.7 for HMM based on sequences of FIGURE 16.
  misc_feature (1)..(364): Functional Homolog Of Ceres ANNOT ID no. 869790 at SEQ ID NO. 342

SEQ ID NO: 576 - protein, 360 aa, Papaver somniferum; identical to SEQ ID NO: 382
  misc_feature (1)..(360): Public GI ID no.33286376
  misc_feature (1)..(360): Bit score of 979.4 for HMM based on sequences of FIGURE 16.
  misc_feature (28)..(80): Pfam Name: Dimerisation Pfam Description: Dimerisation domain
  misc_feature (89)..(336): Pfam Name: Methyltransf_2 Pfam Description: O-methyltransferase
  misc_feature (89)..(336): Pfam Name: Methyltransf_2 Pfam Description: O-methyltransferase
  misc_feature (1)..(360): Bit score of 979.4 for HMM based on sequences of FIGURE 16.
  misc_feature (1)..(360): Functional Homolog Of Ceres ANNOT ID no. 869790 at SEQ ID NO. 342

SEQ ID NO: 577 - protein, 365 aa, Mesembryanthemum crystallinum
  misc_feature (1)..(365): Public GI ID no.1170555
  misc_feature (1)..(365): Bit score of 839.9 for HMM based on sequences of FIGURE 16.
  misc_feature (36)..(87): Pfam Name: Dimerisation Pfam Description: Dimerisation domain
  misc_feature (96)..(341): Pfam Name: Methyltransf_2 Pfam Description: O-methyltransferase
  misc_feature (96)..(341): Pfam Name: Methyltransf_2 Pfam Description: O-methyltransferase
  misc_feature (1)..(365): Bit score of 839.9 for HMM based on sequences of FIGURE 16.
  misc_feature (1)..(365): Functional Homolog Of Ceres ANNOT ID no. 869790 at SEQ ID NO. 342
MTTYTNGNYTQPKTLDKDEQLAGLAVTLANAAAFPMILKSAFELKILDIFSKAGEGVFVSTSEIASQIGAKNPNAPVLLDRMLRLLASHSVLTCKLQKGEGGSQRVYGPAPLCNYLASNDGQGSLGPLLVLHHDKVMMESWFHLNDYILEGGVPFKRAHGMIQFDYTGTDERFNHVFNQGMAHHTILVMKKLLDNYNGFNDVKVLVDVGGNIGVNVSMIVAKHTHIKGINYDLPHVIADAPSYPGVEHVGGNMFESIPQADAIFMKWVLHDWSDEHCVKILNKCYESLAKGGKIILVESLIPVIPEDNLESHMVFSLDCHTLVHNQGGKERSKEDFEALASKTGFSTVDVICCAYDTWVMELYKK

SEQ ID NO: 578 - DNA, 1415 bp, Gossypium hirsutum
  misc_feature (1)..(1415): Ceres CLONE ID no.1838010
  misc_feature (1)..(1415): Encodes the peptide sequence at SEQ ID NO 579
atgcccatatcttctttattctctgcaatctcttctttttagagtttcatcacaccagatattacaatgggttcaatcggtgaaactcaaatgacacccacccaagtctcagatgaggaagccaacttattcgctatgcaacttgccagtgcatcagttctccccatggtcctcaaatcagccattgaacttgacttgctggagatcatggccaaagctggtccaggtgctttcttgtccccaaaagaagtggcttccaagctccccaccaccaaccctgatgcacccgtcatgctggaccgtatcttgcgtctcctggctagctacaacgtcctcacttgctccttgcgtacccttcctgatggcaaagtggaaagactctatggccttggccctgtctgcaaattcttgaccaagaacgaagatggtgtcactctttccgcccttagtctcatgaatcaagacaaggtccttatggagagctggtactacttgaaagatgctgtgctggatggtggaattccattcaacaaggcctatggtatgactgcatttgagtaccatggcactgatactagattcaacaaggttttcaacaggggaatgtctgatcactctaccatcaccatgaagaagattctcgatacatatgatggtttccaaggactaaaaacattggtcgatgttggcggtggtaccggtgccacgcttagcatgatcgtctctaagtaccccaccataaaaggcattaacttcgatttgcctcatgtcattgaggatgctcctagctgtcctggtgtggagcatgttggtggagacatgtttgtaagtgtaccaaaaggagatgccattttcatgaagtggatatgtcatgattggagcgacgaacactgcgccaagtttttgaagaactgctatgaagctttgccagacaacgggaaagtgattgttgccgaatgcattcttcctgattaccccgatcctagccttgccacgaagttggttgtccatattgattgcatcatgttggctcacaaccctggtgggaaagagaggaccgcaaaggaattcaaggcactagcaacgggtgcgggatttcaaggcttccaaatcaaatgctccgcttttggcaccaacatcatggagtttctcaaaagtgtttgaatcttacatgcttttggattctgaagcttggtgattgttgtctcaaaggtggattttctggaattacatactttttgtttgacagaaaacaataaagaacgaaatttcatggtttttacgtagaagaaataccatactatatccactaccttactgtaactattaaacaaagttaaaaggcataaagcctctactttgagaatgattcatggagaagatgattgtttaaataaaaaaaaaaaaaaaaaaaa

SEQ ID NO: 579 - protein, 365 aa, Gossypium hirsutum
  misc_feature (1)..(365): Ceres CLONE ID no.1838010
  misc_feature (1)..(365): Bit score of 1082.1 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1082.1 for HMM based on sequences of FIGURE 16.
  misc_feature (1)..(365): Functional Homolog Of Ceres ANNOT ID no. 869790 at SEQ ID NO. 342
MGSIGETQMTPTQVSDEEANLFAMQLASASVLPMVLKSAIELDLLEIMAKAGPGAFLSPKEVASKLPTTNPDAPVMLDRILRLLASYNVLTCSLRTLPDGKVERLYGLGPVCKFLTKNEDGVTLSALSLMNQDKVLMESWYYLKDAVLDGGIPFNKAYGMTAFEYHGTDTRFNKVFNRGMSDHSTITMKKILDTYDGFQGLKTLVDVGGGTGATLSMIVSKYPTIKGINFDLPHVIEDAPSCPGVEHVGGDMFVSVPKGDAIFMKWICHDWSDEHCAKFLKNCYEALPDNGKVIVAECILPDYPDPSLATKLVVHIDCIMLAHNPGGKERTAKEFKALATGAGFQGFQIKCSAFGTNIMEFLKSV

SEQ ID NO: 580 - protein, 365 aa, Populus tremuloides; identical to SEQ ID NO: 388
  misc_feature (1)..(365): Public GI ID no.231757
  misc_feature (1)..(365): Bit score of 1103.9 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1103.9 for HMM based on sequences of FIGURE 16.
  misc_feature (1)..(365): Functional Homolog Of Ceres ANNOT ID no. 869790 at SEQ ID NO. 342

SEQ ID NO: 581 - protein, 364 aa, Populus tremuloides
  misc_feature (1)..(364): Public GI ID no.29839286
  misc_feature (1)..(364): Bit score of 1028.3 for HMM based on sequences of FIGURE 16.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(364): Bit score of 1028.3 for HMM based on sequences of FIGURE 16.
  misc_feature (1)..(364): Functional Homolog Of Ceres ANNOT ID no. 869790 at SEQ ID NO. 342
MGSTGETQMSPAQILDEEANFALQLISSSVLPMVLKTAIELDLLEIMAKAGPGALLPPSDIASHLPTKNPNAPVMLDRILRLLASYSILICSLRDLPDGKVERLYGLASVCKFLTRNEDGVSVSPLCLMNQDKVLMESWYHLKDAILEGGIPFNKAYGMTAFEYHGTDPRFNKVFNKGMSVHSKMAMKKILETYKGFEGLASLVDVGGGTGAVVSTIVSKYPSIKGINFDLPHVIADAPAFPGVENVGGDMFVSVPKADAVFMKWICHDWSDEHCLTFLKNCYDALPENGKVILVECILPVAPDTSLATKGVMHVDVIMLAHNPGGKERTDREFESLARGAGFKGFEVMCCAFNTHVIEFRKKA

SEQ ID NO: 582 - DNA, 1095 bp, Populus balsamifera subsp. trichocarpa
  misc_feature (1)..(1095): Ceres ANNOT ID no.1521032
  misc_feature (1)..(1095): Encodes the peptide sequence at SEQ ID NO 583
atgggttcgacaggtgaaactcagatgactccaactcaggtatcagatgaagaggcacacctctttgccatgcaactagccagtgcttcagttctaccaatgatcctcaaaacagccattgaactcgaccttcttgaaatcatggctaaagctggccctggtgctttcttgtccacatctgagatagcttctcacctccctaccaaaaaccctgatgcgcctgtcatgttagaccgtatcttgcgcctcctggctagctactccattcttacttgctctctgaaagatcttcctgatgggaaagttgagagactgtatggccttgctcctgtttgcaaattcttgaccaagaacgaggatggtgtctctgtcagccctctctgtctcatgaaccaggacaaggtcctcatggaaagctggtattatttgaaagatgcaattcttgatggaggaattccatttaacaaggcctatgggatgactgcatttgaatatcatggcacggatccaagattcaacaaggtgttcaataagggaatgtctgaccactctaccattaccatgaagaagcttcttgagacctacaaaggctttgaaggcctcacatccttggtggatgttggtggtgggactggagctgtcgttaacaccatcgtctctaaatacccttcaattaagggcattaactttgatctgccccacgtcattgaggatgccccatcttatcccggtgtggagcatgttggtggggacatgtttgttagtgtgcccaaagcagatgccgttttcatgaagtggatatgccatgattggagcgacgcacactgcttaaaattcttgaagaattgctatgacgccttgccggaaaacggcaaggtgatacttgttgagtgcattcttcccgtggctcctgacacaagccttgccaccaagggagtcgtgcacattgatgttatcatgctggcgcacaaccccggtgggaaagagaggaccgaaaaggaatttgagggcttagcaaagggagctggctttcaaggttttgaagtaatgtgctgtgcattcaacacacatgtcattgaattccgcaagaactaa

SEQ ID NO: 583 - protein, 356 aa, Populus balsamifera subsp. trichocarpa
  misc_feature (1)..(356): Ceres ANNOT ID no.1521032
  misc_feature (1)..(356): Bit score of 1071.4 for HMM based on sequences of FIGURE 16.
  misc_feature (26)..(77): Pfam Name: Dimerisation Pfam Description: Dimerisation domain
  misc_feature (86)..(332): Pfam Name: Methyltransf_2 Pfam Description: O-methyltransferase
  misc_feature (86)..(332): Pfam Name: Methyltransf_2 Pfam Description: O-methyltransferase
  misc_feature (1)..(356): Bit score of 1071.4 for HMM based on sequences of FIGURE 16.
  misc_feature (1)..(356): Functional Homolog Of Ceres ANNOT ID no. 869790 at SEQ ID NO. 342
MTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILDGGIPFNKAYGMTAFEYHGTDPRFNKVFNKGMSDHSTITMKKLLETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHIDVIMLAHNPGGKERTEKEFEGLAKGAGFQGFEVMCCAFNTHVIEFRKN

SEQ ID NO: 584 - DNA, 1095 bp, Populus balsamifera subsp. trichocarpa
  misc_feature (1)..(1095): Ceres ANNOT ID no.1472909
  misc_feature (1)..(1095): Encodes the peptide sequence at SEQ ID NO 585
atgggttcaacaggtgaaactcagatgtctccagctcagatattagatgaagaagcgaattttgccatgcaactgatcagttcttcagtgctacctatggtcctcaaaacagccattgaacttgaccttcttgaaatcatggctaaagctggccctggtgctctcttgtccccatccgatatagcttctcatctccctaccaaaaaccctgatgcacctgtcatgttagatcgtatcttgcgccttctggctagttactccattcttatttgctctctaagagatcttcctgatgggaaagttgagagactctatggtcttgcttctgtttgtaagttcttgaccaagaatgaagatggtgtctctgttagccctctctgtctcatgaaccaggacaaggtcctcatggaaagttggtatcatttgaaagacgcgattcttgaaggaggaattccatttaacaaggcctatggaatgactgcatttgaatatcatggcacggatccaagattcaacaaggttttcaacaagggaatgtctgaccattctaaaattgccatgaagaagattcttgagacctacaaaggctttgaaggcctcgcatccttggtggatgttggtggcgggactggtgctgtgcttagcacaatcgtctccaagtacccttcaattaagggcatcaactttgatttgcctcatgtcattgcggatgccccagctttccctggtgtggagaatgttggtggtgacatgtttgttagtgtgcccaaagcagatgctgttttcatgaagtggatatgtcatgattggagcgatgaacactgcttaagattcttgaagaactgctatgatgcgctgccggaaaacgggaaagtgatccttgttgaatgcattctccctgtggctcctgacacaagtcttgccaccaagggagtcatgcacgttgatgccataatgctggcacataaccccggaggaaaagagaggaccgaaaaggaatttgagggcttggccaggggagctggcttcaagggtttcgaagtgatgtgctgtgcattcaatacgtacgtgattgaattccgcaagcaggcctaa

SEQ ID NO: 585 - protein, 364 aa, Populus balsamifera subsp. trichocarpa
  misc_feature (1)..(364): Ceres ANNOT ID no.1472909
  misc_feature (1)..(364): Bit score of 1051.7 for HMM based on sequences of FIGURE 16.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(364): Bit score of 1051.7 for HMM based on sequences of FIGURE 16.
  misc_feature (1)..(364): Functional Homolog Of Ceres ANNOT ID no. 869790 at SEQ ID NO. 342
MGSTGETQMSPAQILDEEANFAMQLISSSVLPMVLKTAIELDLLEIMAKAGPGALLSPSDIASHLPTKNPDAPVMLDRILRLLASYSILICSLRDLPDGKVERLYGLASVCKFLTKNEDGVSVSPLCLMNQDKVLMESWYHLKDAILEGGIPFNKAYGMTAFEYHGTDPRFNKVFNKGMSDHSKIAMKKILETYKGFEGLASLVDVGGGTGAVLSTIVSKYPSIKGINFDLPHVIADAPAFPGVENVGGDMFVSVPKADAVFMKWICHDWSDEHCLRFLKNCYDALPENGKVILVECILPVAPDTSLATKGVMHVDAIMLAHNPGGKERTEKEFEGLARGAGFKGFEVMCCAFNTYVIEFRKQA

SEQ ID NO: 586 - protein, 364 aa, Populus x generosa; identical to SEQ ID NO: 391
  misc_feature (1)..(364): Public GI ID no.7332271
  misc_feature (1)..(364): Bit score of 1096.5 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(364): Bit score of 1096.5 for HMM based on sequences of FIGURE 16.
  misc_feature (1)..(364): Functional Homolog Of Ceres ANNOT ID no. 869790 at SEQ ID NO. 342

SEQ ID NO: 587 - protein, 364 aa, Populus x generosa; identical to SEQ ID NO: 392
  misc_feature (1)..(364): Public GI ID no.444327
  misc_feature (1)..(364): Bit score of 1091.9 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(364): Bit score of 1091.9 for HMM based on sequences of FIGURE 16.
  misc_feature (1)..(364): Functional Homolog Of Ceres ANNOT ID no. 869790 at SEQ ID NO. 342

SEQ ID NO: 588 - DNA, 1219 bp, Arabidopsis thaliana
  misc_feature (1)..(1219): Ceres CLONE ID no.9016
  misc_feature (1)..(1219): Encodes the peptide sequence at SEQ ID NO 589
agaaactcctcactttcgaaaaaaacaagatcattacacaaaaatgggacacctaattcctcaaaccggagatgaagagaccgagcttggtttagctgcggttaggctagctaactgtgcagccttcccaatggttttcaaagctgccatcgagctcggtgtcatcgacactctctacttagctgctcgtgatgacgtcaccggatccagttccttcctcacaccttctgatatagctattaggctccccacaaaacctagtaaccctgaagcaccagctctgttggatcgtattcttcgtttacttgctagctactccatggtcaagtgccaaattatcgatggtaacagagtctacaaagcagagccgatttgtcgatatttcttgaaagataatgttgatgaagaattaggaacacttgcttctcaacttattgtcactctcgataccgtcttcctcaatacatggggagaattaaaaaatgtggtactagaaggaggagttgcatttggccgtgccaatggtggtttgaaactctttgactatattagcaaagatgagagattaagcaaactctttaaccggaccggattctctgtcgcggttttgaaaaagatcctacaagtttatagtggtttcgaaggagttaatgtgttggttgatgtaggaggtggagttggtgacacacttggttttgttacttcaaagtatccaaacattaagggtatcaattttgatctaacttgtgctttaacacaagctccttcttatcctaatgtggaacatgtagctggagacatgtttgttgatgtcccaaaaggtgatgctatcctcttgaaacgtatacttcatgactggactgatgaagactgtgaaaagattctcaagaattgtkggaaagcattacctgagaatgggaaagtgattgtcatggaagtagttactccagatgaagcagataatcgtgatgtgatatccaacattgcttttgatatggatctgttgatgctcactcaattatctggaggtaaagagaggtcgcgggccgagtatgtagctatggctgctaactcgggttttccgcgttgcaactttgtatgcagtgcatatcatttgtgggtcattgagttaacgaaacaggcttagagttgtaagattatgtttcttcctgtgttctataaagagtgtgaaccgtctcatggtaataaaagttgtatg

SEQ ID NO: 589 - protein, 381 aa, Arabidopsis thaliana
  misc_feature (1)..(381): Ceres CLONE ID no.9016
  misc_feature (1)..(381): Bit score of 712.7 for HMM based on sequences of FIGURE 16.
  misc_feature (113)..(356): Pfam Name: Methyltransf_2 Pfam Description: O-methyltransferase
  misc_feature (44)..(103): Pfam Name: Dimerisation Pfam Description: Dimerisation domain
  misc_feature (1)..(381): Bit score of 712.7 for HMM based on sequences of FIGURE 16.
  misc_feature (1)..(381): Functional Homolog Of Ceres ANNOT ID no. 869790 at SEQ ID NO. 342
  misc_feature (299)..(299): Xaa is any aa, unknown, or other
ETPHFRKKQDHYTKMGHLIPQTGDEETELGLAAVRLANCAAFPMVFKAAIELGVIDTLYLAARDDVTGSSSFLTPSDIAIRLPTKPSNPEAPALLDRILRLLASYSMVKCQIIDGNRVYKAEPICRYFLKDNVDEELGTLASQLIVTLDTVFLNTWGELKNVVLEGGVAFGRANGGLKLFDYISKDERLSKLFNRTGFSVAVLKKILQVYSGFEGVNVLVDVGGGVGDTLGFVTSKYPNIKGINFDLTCALTQAPSYPNVEHVAGDMFVDVPKGDAILLKRILHDWTDEDCEKILKNCXKALPENGKVIVMEVVTPDEADNRDVISNIAFDMDLLMLTQLSGGKERSRAEYVAMAANSGFPRCNFVCSAYHLWVIELTKQA

SEQ ID NO: 590 - protein, 338 aa, Arabidopsis thaliana
  misc_feature (1)..(338): Public GI ID no.21617938
  misc_feature (1)..(338): Bit score of 636.4 for HMM based on sequences of FIGURE 16.
  misc_feature (1)..(60): Pfam Name: Dimerisation Pfam Description: Dimerisation domain
  misc_feature (70)..(313): Pfam Name: Methyltransf_2 Pfam Description: O-methyltransferase
  misc_feature (1)..(338): Bit score of 636.4 for HMM based on sequences of FIGURE 16.
  misc_feature (1)..(338): Functional Homolog Of Ceres ANNOT ID no. 869790 at SEQ ID NO. 342
  misc_feature (256)..(256): Xaa is any aa, unknown, or other
MVFKAAIELGVIDTLYLAARDDVTGSSSFLTPSDIAIRLPTKPSNPEAPALLDRILRLLASYSMVKCQIIDGNRVYKAEPICRYFLKDNVDEELGTLASQLIVTLDTVFLNTWGELKNVVLEGGVAFGRANGGLKLFDYISKDERLSKLFNRTGFSVAVLKKILQVYSGFEGVNVLVDVGGGVGDTLGFVTSKYPNIKGINFDLTCALTQAPSYPNVEHVAGDMFVDVPKGDAILLKRILHDWTDEDCEKILKNCXKALPENGKVIVMEVVTPDEADNRDVISNIAFDMDLLMLTQLSGGKERSRAEYVAMAANSGFPRCNFVCSAYHLWVIELTKQA

SEQ ID NO: 591 - DNA, 1326 bp, Brassica napus
  misc_feature (1)..(1326): Ceres CLONE ID no.1086143
  misc_feature (1)..(1326): Encodes the peptide sequence at SEQ ID NO 592
atcacacactcctctcaaaacagagaaacaaaagaaaaagaaacattccaagaatatcttagagatttcaagaaaaatgggatcaacggcggagacacagataactccggtacaagtcaccgacgacgaagccgctctctttgccatgcagctagccagcgcctccgtccttcccatggttttaaagtccgcgctagaccttgatcttctcgagatcatggccaagaactcttctccgatgtctccctctgagattgcttctaaacttcagaccaaaaaccccgaagctccggtcatgctcgaccgaatcctccgtcttctcacgtcttactccatcctcacctgctccaaccgaaccattcccggcggagacagcgtcgagaggatttacgggcttggtccggtttgcaagtacttgaccaagaacgaagatggtgtctctatagctgctctttgtcttatgaaccaagacaaggttctcatggaaagctggtaccatttgaaagatgcaattcttgatggtgggattccattcaacaaggcttatggaatgagcgcttttgagtaccacgggaaggatctaaggttcaacacggtattcaacaatggaatgtctaaccattcaaccattacaatgaagaagattctcgagacctataagggttttgagggtttgacttctttggttgacgttggtggtggcattggtgctactctcaaaatgattgtctctaagtaccctgaccttaaaggcatcaactttgatctcccacatgtcatcgaagaagctacttctcatcccggtattgatcatgttggaggagatatgtttgtaagtgtccctaaaggtgatgcaattttcatgaagtggatatgccacgactggagcgatgaacactgcgtgaaattcttgaagaactgctacgaggcgcttccagaggatggaaaagtgatactagcagagtgtatacttccagagacaccagactcaagcctctcgaccaaacaagtagtccatgttgattgcattatgttggctcacaaccctggaggcaaagaacggaccgagaaggagttcgaggcattagctaaaggatcaggcttcaaaggcatcaatgttgcctgcaatgcttttggtgtttacgttattgagctgctcaaaaagatgtaagacacacacacacacacacaatccatgtaataatgatattatatgtaaacattgctttcatgtacgtctacttcaccgtctttgttttaaaactatgatgtgtaataatggtttattaagagattgatctaaagttttcaaaaaaaaaaaaaaaa

SEQ ID NO: 592 - protein, 364 aa, Brassica napus
  misc_feature (1)..(364): Ceres CLONE ID no.1086143
  misc_feature (1)..(364): Bit score of 1032.7 for HMM based on sequences of FIGURE 16.
  misc_feature (34)..(83): Pfam Name: Dimerisation Pfam Description: Dimerisation domain
  misc_feature (94)..(339): Pfam Name: Methyltransf_2 Pfam Description: O-methyltransferase
  misc_feature (94)..(339): Pfam Name: Methyltransf_2 Pfam Description: O-methyltransferase
  misc_feature (1)..(364): Bit score of 1032.7 for HMM based on sequences of FIGURE 16.
  misc_feature (1)..(364): Functional Homolog Of Ceres ANNOT ID no. 869790 at SEQ ID NO. 342
MGSTAETQITPVQVTDDEAALFAMQLASASVLPMVLKSALDLDLLEIMAKNSSPMSPSEIASKLQTKNPEAPVMLDRILRLLTSYSILTCSNRTIPGGDSVERIYGLGPVCKYLTKNEDGVSIAALCLMNQDKVLMESWYHLKDAILDGGIPFNKAYGMSAFEYHGKDLRFNTVFNNGMSNHSTITMKKILETYKGFEGLTSLVDVGGGIGATLKMIVSKYPDLKGINFDLPHVIEEATSHPGIDHVGGDMFVSVPKGDAIFMKWICHDWSDEHCVKFLKNCYEALPEDGKVILAECILPETPDSSLSTKQVVHVDCIMLAHNPGGKERTEKEFEALAKGSGFKGINVACNAFGVYVIELLKKM

SEQ ID NO: 593 - DNA, 1368 bp, Brassica napus; identical to SEQ ID NO: 398
  misc_feature (1)..(1368): Ceres CLONE ID no.1118817
  misc_feature (1)..(1368): Encodes the peptide sequence at SEQ ID NO 594

SEQ ID NO: 594 - protein, 364 aa, Brassica napus; identical to SEQ ID NO: 399
  misc_feature (1)..(364): Ceres CLONE ID no.1118817
  misc_feature (1)..(364): Bit score of 1017.7 for HMM based on sequences of FIGURE 16.
  misc_feature (34)..(83): Pfam Name: Dimerisation Pfam Description: Dimerisation domain
  misc_feature (94)..(339): Pfam Name: Methyltransf_2 Pfam Description: O-methyltransferase
  misc_feature (94)..(339): Pfam Name: Methyltransf_2 Pfam Description: O-methyltransferase
  misc_feature (1)..(364): Bit score of 1017.7 for HMM based on sequences of FIGURE 16.
  misc_feature (1)..(364): Functional Homolog Of Ceres ANNOT ID no. 869790 at SEQ ID NO. 342

SEQ ID NO: 595 - protein, 365 aa, Malus x domestica; identical to SEQ ID NO: 404
  misc_feature (1)..(365): Public GI ID no.114199044
  misc_feature (1)..(365): Bit score of 1082.2 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1082.2 for HMM based on sequences of FIGURE 16.
  misc_feature (1)..(365): Functional Homolog Of Ceres ANNOT ID no. 869790 at SEQ ID NO. 342

SEQ ID NO: 596 - protein, 365 aa, Malus x domestica; identical to SEQ ID NO: 403
  misc_feature (1)..(365): Public GI ID no.114199048
  misc_feature (1)..(365): Bit score of 1084.8 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1084.8 for HMM based on sequences of FIGURE 16.
  misc_feature (1)..(365): Functional Homolog Of Ceres ANNOT ID no. 869790 at SEQ ID NO. 342

SEQ ID NO: 597 - protein, 365 aa, Malus x domestica; identical to SEQ ID NO: 405
  misc_feature (1)..(365): Public GI ID no.114199046
  misc_feature (1)..(365): Bit score of 1038.8 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1038.8 for HMM based on sequences of FIGURE 16.
  misc_feature (1)..(365): Functional Homolog Of Ceres ANNOT ID no. 869790 at SEQ ID NO. 342

SEQ ID NO: 598 - protein, 365 aa, Malus x domestica; identical to SEQ ID NO: 406
  misc_feature (1)..(365): Public GI ID no.114199050
  misc_feature (1)..(365): Bit score of 1030.6 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1030.6 for HMM based on sequences of FIGURE 16.
  misc_feature (1)..(365): Functional Homolog Of Ceres ANNOT ID no. 869790 at SEQ ID NO. 342

SEQ ID NO: 599 - protein, 365 aa, Prunus dulcis; identical to SEQ ID NO: 407
  misc_feature (1)..(365): Public GI ID no.3913295
  misc_feature (1)..(365): Bit score of 1103.0 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1103 for HMM based on sequences of FIGURE 16.
  misc_feature (1)..(365): Functional Homolog Of Ceres ANNOT ID no. 869790 at SEQ ID NO. 342

SEQ ID NO: 600 - DNA, 1420 bp, Glycine max
  misc_feature (1)..(1420): Ceres CLONE ID no.561287
  misc_feature (1)..(1420): Encodes the peptide sequence at SEQ ID NO 601
atcgcttactaaaagcagctagctagcttcaattaacacaacattttctaactcctctctctttatatatagctgctttgtttggtacattcatttcatatcatggctccatcattggaaaccagtaacggtgaagccatgcaccttaaacaggttgaagaagagcaagatggtatacttttcgccatgaacatgatgtctaccatggtgtatccgtttgtggttcggaccgcgattgagttagggatctttgacatcatagcgaaagccggtgaaggtgcgaagctatcagcagaggagattatagagcaacttggcacaaagaaccctgaagctcccacgatgttggaccggcttctcaggttattggctagtcactccatgctatcttcctctcttgatactgaagatctccaacatggccaaaactctcctaagaggctctatagtcttacctatgcttccaagtattttgtcactgatgctgatggtgtctcgttcggagctaccttgaacttacttcttgacaaggtcttcttggaaagctggactgaactgaaaggagccatcttggaagggggtgtagcattcaacagggttcattccatgcactcatttgagtacccagcagttgatcctaggttcaatgatgttttcaacaaagctatgttcaaccttactactatagtcatgaagagggttcttgagttttacgaagggtttaagaacattaataggcttgtggatgttggtggtggtcttgggatcaatctcaatctaatcacttctaaatatccacatgttcaaggtgttaattttgacttgccacatgtcatagagcatgctcctacataccccggtatcgaacatgtaggaggagatatgtttgagagtgttcccaacggagacgccatttttatgaagtggatacttcacgattggagtgatgaacaatgcttgaagttgttgaagaattgtcataaagctattcctagtgatggaaaagtgattgttgtggacttaattcttcccattttgcccgagagcacagttactgctaagagtggtttccaagctgacctcttaatgatgactcaaaactcaggaggaaaagagagaacccaacatgaattcatggaattggcattaagttctggattcagtggcatcaaaatcgtttgcagtgtctctggcttctgggttatggaattttataagtaaacacacttatcgagtgttgctcaaattgttcttctattatccttgcttgttgcttgaaaaaatagtatcatgctcgaacattatttaccaattatctaaggacatatgttcaatctttgttgttgttatttatatatatatatatataaaagatattagccaataaagatcttacctcgtattgtgaaggttttcccac

SEQ ID NO: 601 - protein, 372 aa, Glycine max
  misc_feature (1)..(372): Ceres CLONE ID no.561287
  misc_feature (1)..(372): Bit score of 832.0 for HMM based on sequences of FIGURE 16.
  misc_feature (107)..(349): Pfam Name: Methyltransf_2 Pfam Description: O-methyltransferase
  misc_feature (39)..(90): Pfam Name: Dimerisation Pfam Description: Dimerisation domain
  misc_feature (1)..(372): Bit score of 832 for HMM based on sequences of FIGURE 16.
  misc_feature (1)..(372): Functional Homolog Of Ceres ANNOT ID no. 869790 at SEQ ID NO. 342
MAPSLETSNGEAMHLKQVEEEQDGILFAMNMMSTMVYPFVVRTAIELGIFDIIAKAGEGAKLSAEEIIEQLGTKNPEAPTMLDRLLRLLASHSMLSSSLDTEDLQHGQNSPKRLYSLTYASKYFVTDADGVSFGATLNLLLDKVFLESWTELKGAILEGGVAFNRVHSMHSFEYPAVDPRFNDVFNKAMFNLTTIVMKRVLEFYEGFKNINRLVDVGGGLGINLNLITSKYPHVQGVNFDLPHVIEHAPTYPGIEHVGGDMFESVPNGDAIFMKWILHDWSDEQCLKLLKNCHKAIPSDGKVIVVDLILPILPESTVTAKSGFQADLLMMTQNSGGKERTQHEFMELALSSGFSGIKIVCSVSGFWVMEFYK

SEQ ID NO: 602 - protein, 365 aa, Medicago sativa; identical to SEQ ID NO: 410
  misc_feature (1)..(365): Public GI ID no.116908
  misc_feature (1)..(365): Bit score of 1085.7 for HMM based on sequences of FIGURE 16.
  misc_feature (34)..(85): Pfam Name: Dimerisation Pfam Description: Dimerisation domain
  misc_feature (95)..(340): Pfam Name: Methyltransf_2 Pfam Description: O-methyltransferase
  misc_feature (95)..(340): Pfam Name: Methyltransf_2 Pfam Description: O-methyltransferase
  misc_feature (1)..(365): Bit score of 1085.7 for HMM based on sequences of FIGURE 16.
  misc_feature (1)..(365): Functional Homolog Of Ceres ANNOT ID no. 869790 at SEQ ID NO. 342

SEQ ID NO: 603 - protein, 365 aa, Medicago truncatula; identical to SEQ ID NO: 411
  misc_feature (1)..(365): Public GI ID no.92878636
  misc_feature (1)..(365): Bit score of 1089.8 for HMM based on sequences of FIGURE 16.
  misc_feature (34)..(85): Pfam Name: Dimerisation Pfam Description: Dimerisation domain
  misc_feature (95)..(340): Pfam Name: Methyltransf_2 Pfam Description: O-methyltransferase
  misc_feature (95)..(340): Pfam Name: Methyltransf_2 Pfam Description: O-methyltransferase
  misc_feature (1)..(365): Bit score of 1089.8 for HMM based on sequences of FIGURE 16.
  misc_feature (1)..(365): Functional Homolog Of Ceres ANNOT ID no. 869790 at SEQ ID NO. 342

SEQ ID NO: 604 - protein, 366 aa, Eucalyptus gunnii; identical to SEQ ID NO: 412
  misc_feature (1)..(366): Public GI ID no.1169009
  misc_feature (1)..(366): Bit score of 1079.8 for HMM based on sequences of FIGURE 16.
  misc_feature (35)..(86): Pfam Name: Dimerisation Pfam Description: Dimerisation domain
  misc_feature (95)..(341): Pfam Name: Methyltransf_2 Pfam Description: O-methyltransferase
  misc_feature (95)..(341): Pfam Name: Methyltransf_2 Pfam Description: O-methyltransferase
  misc_feature (1)..(366): Bit score of 1079.8 for HMM based on sequences of FIGURE 16.
  misc_feature (1)..(366): Functional Homolog Of Ceres ANNOT ID no. 869790 at SEQ ID NO. 342

SEQ ID NO: 605 - protein, 363 aa, Catharanthus roseus; identical to SEQ ID NO: 413
  misc_feature (1)..(363): Public GI ID no.29839377
  misc_feature (1)..(363): Bit score of 1072.0 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(363): Bit score of 1072 for HMM based on sequences of FIGURE 16.
  misc_feature (1)..(363): Functional Homolog Of Ceres ANNOT ID no. 869790 at SEQ ID NO. 342

SEQ ID NO: 606 - protein, 359 aa, Capsicum annuum; identical to SEQ ID NO: 414
  misc_feature (1)..(359): Public GI ID no.12003964
  misc_feature (1)..(359): Bit score of 1060.9 for HMM based on sequences of FIGURE 16.
  misc_feature (30)..(81): Pfam Name: Dimerisation Pfam Description: Dimerisation domain
  misc_feature (90)..(336): Pfam Name: Methyltransf_2 Pfam Description: O-methyltransferase
  misc_feature (90)..(336): Pfam Name: Methyltransf_2 Pfam Description: O-methyltransferase
  misc_feature (1)..(359): Bit score of 1060.9 for HMM based on sequences of FIGURE 16.
  misc_feature (1)..(359): Functional Homolog Of Ceres ANNOT ID no. 869790 at SEQ ID NO. 342

SEQ ID NO: 607 - protein, 359 aa, Capsicum annuum; identical to SEQ ID NO: 415
  misc_feature (1)..(359): Public GI ID no.30315948
  misc_feature (1)..(359): Bit score of 1052.7 for HMM based on sequences of FIGURE 16.
  misc_feature (30)..(81): Pfam Name: Dimerisation Pfam Description: Dimerisation domain
  misc_feature (90)..(336): Pfam Name: Methyltransf_2 Pfam Description: O-methyltransferase
  misc_feature (90)..(336): Pfam Name: Methyltransf_2 Pfam Description: O-methyltransferase
  misc_feature (1)..(359): Bit score of 1052.7 for HMM based on sequences of FIGURE 16.
  misc_feature (1)..(359): Functional Homolog Of Ceres ANNOT ID no. 869790 at SEQ ID NO. 342

SEQ ID NO: 608 - protein, 364 aa, Nicotiana tabacum; identical to SEQ ID NO: 416
  misc_feature (1)..(364): Public GI ID no.396589
  misc_feature (1)..(364): Bit score of 1012.4 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(364): Bit score of 1012.4 for HMM based on sequences of FIGURE 16.
  misc_feature (1)..(364): Functional Homolog Of Ceres ANNOT ID no. 869790 at SEQ ID NO. 342

SEQ ID NO: 609 - protein, 364 aa, Nicotiana tabacum; identical to SEQ ID NO: 417
  misc_feature (1)..(364): Public GI ID no.396591
  misc_feature (1)..(364): Bit score of 1006.5 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(364): Bit score of 1006.5 for HMM based on sequences of FIGURE 16.
  misc_feature (1)..(364): Functional Homolog Of Ceres ANNOT ID no. 869790 at SEQ ID NO. 342

SEQ ID NO: 610 - protein, 361 aa, Lolium perenne; identical to SEQ ID NO: 422
  misc_feature (1)..(361): Public GI ID no.4104224
  misc_feature (1)..(361): Bit score of 947.5 for HMM based on sequences of FIGURE 16.
  misc_feature (31)..(83): Pfam Name: Dimerisation Pfam Description: Dimerisation domain
  misc_feature (92)..(338): Pfam Name: Methyltransf_2 Pfam Description: O-methyltransferase
  misc_feature (92)..(338): Pfam Name: Methyltransf_2 Pfam Description: O-methyltransferase
  misc_feature (1)..(361): Bit score of 947.5 for HMM based on sequences of FIGURE 16.
  misc_feature (1)..(361): Functional Homolog Of Ceres ANNOT ID no. 869790 at SEQ ID NO. 342

SEQ ID NO: 611 - protein, 360 aa, Lolium perenne; identical to SEQ ID NO: 420
  misc_feature (1)..(360): Public GI ID no.2388664
  misc_feature (1)..(360): Bit score of 951.8 for HMM based on sequences of FIGURE 16.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 951.8 for HMM based on sequences of FIGURE 16.
  misc_feature (1)..(360): Functional Homolog Of Ceres ANNOT ID no. 869790 at SEQ ID NO. 342

SEQ ID NO: 612 - protein, 360 aa, Lolium perenne; identical to SEQ ID NO: 421
  misc_feature (1)..(360): Public GI ID no.4104220
  misc_feature (1)..(360): Bit score of 953.0 for HMM based on sequences of FIGURE 16.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 953 for HMM based on sequences of FIGURE 16.
  misc_feature (1)..(360): Functional Homolog Of Ceres ANNOT ID no. 869790 at SEQ ID NO. 342

SEQ ID NO: 613 - protein, 362 aa, Saccharum officinarum; identical to SEQ ID NO: 423
  misc_feature (1)..(362): Public GI ID no.29839259
  misc_feature (1)..(362): Bit score of 962.9 for HMM based on sequences of FIGURE 16.
  misc_feature (31)..(85): Pfam Name: Dimerisation Pfam Description: Dimerisation domain
  misc_feature (94)..(339): Pfam Name: Methyltransf_2 Pfam Description: O-methyltransferase
  misc_feature (94)..(339): Pfam Name: Methyltransf_2 Pfam Description: O-methyltransferase
  misc_feature (1)..(362): Bit score of 962.9 for HMM based on sequences of FIGURE 16.
  misc_feature (1)..(362): Functional Homolog Of Ceres ANNOT ID no. 869790 at SEQ ID NO. 342

SEQ ID NO: 614 - protein, 362 aa, Sorghum bicolor; identical to SEQ ID NO: 425
  misc_feature (1)..(362): Public GI ID no.18033964
  misc_feature (1)..(362): Bit score of 934.5 for HMM based on sequences of FIGURE 16.
  misc_feature (31)..(83): Pfam Name: Dimerisation Pfam Description: Dimerisation domain
  misc_feature (92)..(339): Pfam Name: Methyltransf_2 Pfam Description: O-methyltransferase
  misc_feature (92)..(339): Pfam Name: Methyltransf_2 Pfam Description: O-methyltransferase
  misc_feature (1)..(362): Bit score of 934.5 for HMM based on sequences of FIGURE 16.
  misc_feature (1)..(362): Functional Homolog Of Ceres ANNOT ID no. 869790 at SEQ ID NO. 342

SEQ ID NO: 615 - protein, 362 aa, Sorghum bicolor; identical to SEQ ID NO: 424
  misc_feature (1)..(362): Public GI ID no.28569609
  misc_feature (1)..(362): Bit score of 937.1 for HMM based on sequences of FIGURE 16.
  misc_feature (31)..(83): Pfam Name: Dimerisation Pfam Description: Dimerisation domain
  misc_feature (92)..(339): Pfam Name: Methyltransf_2 Pfam Description: O-methyltransferase
  misc_feature (92)..(339): Pfam Name: Methyltransf_2 Pfam Description: O-methyltransferase
  misc_feature (1)..(362): Bit score of 937.1 for HMM based on sequences of FIGURE 16.
  misc_feature (1)..(362): Functional Homolog Of Ceres ANNOT ID no. 869790 at SEQ ID NO. 342

SEQ ID NO: 616 - protein, 356 aa, Triticum aestivum; identical to SEQ ID NO: 427
  misc_feature (1)..(356): Public GI ID no.77818928
  misc_feature (1)..(356): Bit score of 968.6 for HMM based on sequences of FIGURE 16.
  misc_feature (27)..(78): Pfam Name: Dimerisation Pfam Description: Dimerisation domain
  misc_feature (87)..(333): Pfam Name: Methyltransf_2 Pfam Description: O-methyltransferase
  misc_feature (87)..(333): Pfam Name: Methyltransf_2 Pfam Description: O-methyltransferase
  misc_feature (1)..(356): Bit score of 968.6 for HMM based on sequences of FIGURE 16.
  misc_feature (1)..(356): Functional Homolog Of Ceres ANNOT ID no. 869790 at SEQ ID NO. 342

SEQ ID NO: 617 - protein, 360 aa, Triticum aestivum; identical to SEQ ID NO: 426
  misc_feature (1)..(360): Public GI ID no.30385246
  misc_feature (1)..(360): Bit score of 945.8 for HMM based on sequences of FIGURE 16.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 945.8 for HMM based on sequences of FIGURE 16.
  misc_feature (1)..(360): Functional Homolog Of Ceres ANNOT ID no. 869790 at SEQ ID NO. 342

SEQ ID NO: 618 - DNA, 1413 bp, Triticum aestivum
  misc_feature (1)..(1413): Ceres CLONE ID no.570057
  misc_feature (1)..(1413): Encodes the peptide sequence at SEQ ID NO 619
attcctcatcgctcagtcgcccgctcacaccaaaaacaaccaccagcagtagctcggctccggagaggcagagtcagaggcaaacatgggctccaccgcagccgacatggccgcctccgccgacgaggaggcgtgcatgtatgctctccagctcgtctcgtcgtcgatcctcccgatgacgctcaagaacgccatcgagctgggtctcctggagaccctggtggccgccggcggcaagctgctgacgcccgccgaggtggcagccaagctcccgtccacggcgaatcccgccgcggcggacatggtggaccgcatgctccggctgctggcctcgtacaacgtggtgtcgtgcacgatggaggagggcaaggacggccggctgtcccggcggtacggcgccgcgcccgtgtgcaagttcctcacccccaacgaagacggcgtctccatggcggcgctcgcgctcatgaaccaggacaaggtcctcatggagagctggtactacctgaaggacgcggtccttgacggcggcatcccgttcaacaaggcgtacgggatgtcggcgttcgagtaccacggcacggacccgcgcttcaaccgcgtcttcaacgaggggatgaagaaccactccatcatcatcaccaagaagctcctcgaggtctacaaggggcttcgagggcctcggcaccatcgtcgacgtgggcggcggcgtgggcgccaccgtgggcgccatcgtcgccgcctacccggccatcaagggcatcaacttcgacctcccccacgtcatctccgaggcgccaccgttcccgggcgtcacccacgtcggcggcgacatgttccagaaggtgccctcgggcgacgccatcctcatgaagtggatcctccacgactggagcgacgagcactgcgcgacgctgctcaagaactgctacgacgcgctgccggcgcacggcaaggtggtgctcgtggagtgcatcctgccggtgaacccggaggccacgcccaaggcgcagggggtattccacgtcgacatgatcatgctcgcgcacaaccccggcggcagggagaggtacgagagggagttcgaggccctggccaagggcgccggcttcaaagccatcaagaccacctacatctacgccaacgcatttgccatcgagttcaccaagtagatccatgccaaccgtccaccgctcgctttgagaccatcttcttcttcctcgctggcgctgctgaatatgtactttggcttgctgtttcctctgttttcctaattttgtcatcctagctctgaatcattctgaatgctactggttgtgccgtcgatctacccattcgaaatgtactgtactattaatagtgctgctcttaaaggttgcatgtgatgcaatgacatgatttctctcctttgttgat

SEQ ID NO: 619 - protein, 360 aa, Triticum aestivum
  misc_feature (1)..(360): Ceres CLONE ID no.570057
  misc_feature (1)..(360): Bit score of 958.4 for HMM based on sequences of FIGURE 16.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 958.4 for HMM based on sequences of FIGURE 16.
  misc_feature (1)..(360): Functional Homolog Of Ceres ANNOT ID no. 869790 at SEQ ID NO. 342
MGSTAADMAASADEEACMYALQLVSSSILPMTLKNAIELGLLETLVAAGGKLLTPAEVAAKLPSTANPAAADMVDRMLRLLASYNVVSCTMEEGKDGRLSRRYGAAPVCKFLTPNEDGVSMAALALMNQDKVLMESWYYLKDAVLDGGIPFNKAYGMSAFEYHGTDPRFNRVFNEGMKNHSIIITKKLLEVYKGFEGLGTIVDVGGGVGATVGAIVAAYPAIKGINFDLPHVISEAPPFPGVTHVGGDMFQKVPSGDAILMKWILHDWSDEHCATLLKNCYDALPAHGKVVLVECILPVNPEATPKAQGVFHVDMIMLAHNPGGRERYEREFEALAKGAGFKAIKTTYIYANAFAIEFTK

SEQ ID NO: 620 - DNA, 495 bp, Zea mays
  misc_feature (1)..(495): Ceres CLONE ID no.1064285
  misc_feature (1)..(495): Encodes the peptide sequence at SEQ ID NO 621
aaacagttccacgccgccactccccccaacccgaccacgctgcgcctccgcttgacccccagccgagggaggaatgggtaagggtacgggcagcttcggcaagcgccggaacaagacgcacacgctctgcatccgctgcggccgccgcagcttccacctccagaagagtacctgctcctcctgcggttaccccgccgcccgcatccgcaagtataactggagtgtgaaggccatcaggcgcaagacaaccggtaccggaaggatgaggtacatgcgccacgtgcctcgccgtttcaagagcaacttcagagaagggactgaggctgctcccaagaagagtgctgccgctgccaactaagtctggatgttgctatcaagaatctgataagctagaacattggaacattttgcttgagttgtacttctgaactatttagactgtctccagcaacatcccctaaatttcgtcctctaaaggaatattccttgtccttt

SEQ ID NO: 621 - protein, 357 aa, Zea mays
  misc_feature (1)..(357): Ceres CLONE ID no.1064285
  misc_feature (1)..(357): Bit score of 864.7 for HMM based on sequences of FIGURE 16.
  misc_feature (30)..(82): Pfam Name: Dimerisation Pfam Description: Dimerisation domain
  misc_feature (90)..(334): Pfam Name: Methyltransf_2 Pfam Description: O-methyltransferase
  misc_feature (1)..(357): Bit score of 864.7 for HMM based on sequences of FIGURE 16.
  misc_feature (1)..(357): Functional Homolog Of Ceres ANNOT ID no. 869790 at SEQ ID NO. 342
MGSMAAEMTAVEEEACIYAMQLSSTAVLPLTLKNAIELGMLEVLMGAGGKMLSPSEVAARLPPTTTNPDAPAMVDRMLHLLASYKVVSCEVEEGTHARRYGPTPVCKWFTPNQDGISMAPLLLLTNDKVPMESLYHLKDAVLDGGLPFHKAHGMTMYEYTKTDARLNHVFNEAMKSYTTIVTGKLVELYTGFHDVATLVDVGGGVGATIRAVTSKYPHIKGINFDLPHVIAEAPQSPGVEHVAGDMFKNVPSGDAIVLKWILHNWTDEHCTTLLRNCYNALPAHGKVVVVEGILPVEPEATSRGQQASLSDMIMLTHTAGGKERNQREFEQLAKAAGFTGVKTAYIYSNTWVIELTK

SEQ ID NO: 622 - protein, 360 aa, Festuca arundinacea; identical to SEQ ID NO: 445
  misc_feature (1)..(360): Public GI ID no.14578615
  misc_feature (1)..(360): Bit score of 963.5 for HMM based on sequences of FIGURE 16.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 963.5 for HMM based on sequences of FIGURE 16.
  misc_feature (1)..(360): Functional Homolog Of Ceres ANNOT ID no. 869790 at SEQ ID NO. 342

SEQ ID NO: 623 - protein, 360 aa, Festuca arundinacea; identical to SEQ ID NO: 444
  misc_feature (1)..(360): Public GI ID no.14578611
  misc_feature (1)..(360): Bit score of 961.5 for HMM based on sequences of FIGURE 16.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 961.5 for HMM based on sequences of FIGURE 16.
  misc_feature (1)..(360): Functional Homolog Of Ceres ANNOT ID no. 869790 at SEQ ID NO. 342

SEQ ID NO: 624 - protein, 360 aa, Festuca arundinacea; identical to SEQ ID NO: 443
  misc_feature (1)..(360): Public GI ID no.14578613
  misc_feature (1)..(360): Bit score of 958.3 for HMM based on sequences of FIGURE 16.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 958.3 for HMM based on sequences of FIGURE 16.
  misc_feature (1)..(360): Functional Homolog Of Ceres ANNOT ID no. 869790 at SEQ ID NO. 342

SEQ ID NO: 625 - protein, 360 aa, Festuca arundinacea; identical to SEQ ID NO: 446
  misc_feature (1)..(360): Public GI ID no.14578617
  misc_feature (1)..(360): Bit score of 938.9 for HMM based on sequences of FIGURE 16.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 938.9 for HMM based on sequences of FIGURE 16.
  misc_feature (1)..(360): Functional Homolog Of Ceres ANNOT ID no. 869790 at SEQ ID NO. 342

SEQ ID NO: 626 - protein, 386 aa, Vitis vinifera; identical to SEQ ID NO: 449
  misc_feature (1)..(386): Public GI ID no.7271883
  misc_feature (1)..(386): Bit score of 979.6 for HMM based on sequences of FIGURE 16.
  misc_feature (114)..(361): Pfam Name: Methyltransf_2 Pfam Description: O-methyltransferase
  misc_feature (114)..(361): Pfam Name: Methyltransf_2 Pfam Description: O-methyltransferase
  misc_feature (54)..(105): Pfam Name: Dimerisation Pfam Description: Dimerisation domain
  misc_feature (1)..(386): Bit score of 979.6 for HMM based on sequences of FIGURE 16.
  misc_feature (1)..(386): Functional Homolog Of Ceres ANNOT ID no. 869790 at SEQ ID NO. 342

SEQ ID NO: 627 - protein, 354 aa, Zinnia elegans; identical to SEQ ID NO: 450
  misc_feature (1)..(354): Public GI ID no.29839290
  misc_feature (1)..(354): Bit score of 979.9 for HMM based on sequences of FIGURE 16.
  misc_feature (24)..(76): Pfam Name: Dimerisation Pfam Description: Dimerisation domain
  misc_feature (84)..(331): Pfam Name: Methyltransf_2 Pfam Description: O-methyltransferase
  misc_feature (84)..(331): Pfam Name: Methyltransf_2 Pfam Description: O-methyltransferase
  misc_feature (1)..(354): Bit score of 979.9 for HMM based on sequences of FIGURE 16.
  misc_feature (1)..(354): Functional Homolog Of Ceres ANNOT ID no. 869790 at SEQ ID NO. 342

SEQ ID NO: 628 - protein, 364 aa, Mentha x piperita; identical to SEQ ID NO: 451
  misc_feature (1)..(364): Public GI ID no.38047397
  misc_feature (1)..(364): Bit score of 854.6 for HMM based on sequences of FIGURE 16.
  misc_feature (37)..(88): Pfam Name: Dimerisation Pfam Description: Dimerisation domain
  misc_feature (99)..(341): Pfam Name: Methyltransf_2 Pfam Description: O-methyltransferase
  misc_feature (1)..(364): Bit score of 854.6 for HMM based on sequences of FIGURE 16.
  misc_feature (1)..(364): Functional Homolog Of Ceres ANNOT ID no. 869790 at SEQ ID NO. 342

SEQ ID NO: 629 - protein, 365 aa, Populus sieboldii x Populus grandidentata; identical to SEQ ID NO: 452
  misc_feature (1)..(365): Public GI ID no.29839288
  misc_feature (1)..(365): Bit score of 1099.7 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1099.7 for HMM based on sequences of FIGURE 16.
  misc_feature (1)..(365): Functional Homolog Of Ceres ANNOT ID no. 869790 at SEQ ID NO. 342

SEQ ID NO: 630 - protein, 364 aa, Populus sieboldii x Populus grandidentata; identical to SEQ ID NO: 453
  misc_feature (1)..(364): Public GI ID no.29839289
  misc_feature (1)..(364): Bit score of 1040.9 for HMM based on sequences of FIGURE 16.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(364): Bit score of 1040.9 for HMM based on sequences of FIGURE 16.
  misc_feature (1)..(364): Functional Homolog Of Ceres ANNOT ID no. 869790 at SEQ ID NO. 342

SEQ ID NO: 631 - protein, 365 aa, Stylosanthes humilis; identical to SEQ ID NO: 454
  misc_feature (1)..(365): Public GI ID no.1582580
  misc_feature (1)..(365): Bit score of 1070.9 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1070.9 for HMM based on sequences of FIGURE 16.
  misc_feature (1)..(365): Functional Homolog Of Ceres ANNOT ID no. 869790 at SEQ ID NO. 342

SEQ ID NO: 632 - protein, 365 aa, Iris hollandica; identical to SEQ ID NO: 455
  misc_feature (1)..(365): Public GI ID no.57157826
  misc_feature (1)..(365): Bit score of 978.4 for HMM based on sequences of FIGURE 16.
  misc_feature (35)..(86): Pfam Name: Dimerisation Pfam Description: Dimerisation domain
  misc_feature (96)..(342): Pfam Name: Methyltransf_2 Pfam Description: O-methyltransferase
  misc_feature (96)..(342): Pfam Name: Methyltransf_2 Pfam Description: O-methyltransferase
  misc_feature (1)..(365): Bit score of 978.4 for HMM based on sequences of FIGURE 16.
  misc_feature (1)..(365): Functional Homolog Of Ceres ANNOT ID no. 869790 at SEQ ID NO. 342

SEQ ID NO: 633 - protein, 364 aa, Ipomoea nil; identical to SEQ ID NO: 457
  misc_feature (1)..(364): Public GI ID no.97974184
  misc_feature (1)..(364): Bit score of 1082.2 for HMM based on sequences of FIGURE 16.
  misc_feature (35)..(86): Pfam Name: Dimerisation Pfam Description: Dimerisation domain
  misc_feature (95)..(341): Pfam Name: Methyltransf_2 Pfam Description: O-methyltransferase
  misc_feature (95)..(341): Pfam Name: Methyltransf_2 Pfam Description: O-methyltransferase
  misc_feature (1)..(364): Bit score of 1082.2 for HMM based on sequences of FIGURE 16.
  misc_feature (1)..(364): Functional Homolog Of Ceres ANNOT ID no. 869790 at SEQ ID NO. 342

SEQ ID NO: 634 - protein, 364 aa, Ipomoea nil; identical to SEQ ID NO: 456
  misc_feature (1)..(364): Public GI ID no.97974173
  misc_feature (1)..(364): Bit score of 1076.9 for HMM based on sequences of FIGURE 16.
  misc_feature (35)..(86): Pfam Name: Dimerisation Pfam Description: Dimerisation domain
  misc_feature (95)..(341): Pfam Name: Methyltransf_2 Pfam Description: O-methyltransferase
  misc_feature (95)..(341): Pfam Name: Methyltransf_2 Pfam Description: O-methyltransferase
  misc_feature (1)..(364): Bit score of 1076.9 for HMM based on sequences of FIGURE 16.
  misc_feature (1)..(364): Functional Homolog Of Ceres ANNOT ID no. 869790 at SEQ ID NO. 342

SEQ ID NO: 635 - protein, 343 aa, Chrysosplenium americanum; identical to SEQ ID NO: 460
  misc_feature (1)..(343): Public GI ID no.567077
  misc_feature (1)..(343): Bit score of 885.3 for HMM based on sequences of FIGURE 16.
  misc_feature (15)..(64): Pfam Name: Dimerisation Pfam Description: Dimerisation domain
  misc_feature (75)..(316): Pfam Name: Methyltransf_2 Pfam Description: O-methyltransferase
  misc_feature (1)..(343): Bit score of 885.3 for HMM based on sequences of FIGURE 16.
  misc_feature (1)..(343): Functional Homolog Of Ceres ANNOT ID no. 869790 at SEQ ID NO. 342

SEQ ID NO: 636 - protein, 343 aa, Chrysosplenium americanum; identical to SEQ ID NO: 459
  misc_feature (1)..(343): Public GI ID no.24212067
  misc_feature (1)..(343): Bit score of 982.6 for HMM based on sequences of FIGURE 16.
  misc_feature (15)..(64): Pfam Name: Dimerisation Pfam Description: Dimerisation domain
  misc_feature (75)..(316): Pfam Name: Methyltransf_2 Pfam Description: O-methyltransferase
  misc_feature (75)..(316): Pfam Name: Methyltransf_2 Pfam Description: O-methyltransferase
  misc_feature (1)..(343): Bit score of 982.6 for HMM based on sequences of FIGURE 16.
  misc_feature (1)..(343): Functional Homolog Of Ceres ANNOT ID no. 869790 at SEQ ID NO. 342

SEQ ID NO: 637 - protein, 370 aa, Clarkia breweri; identical to SEQ ID NO: 462
  misc_feature (1)..(370): Public GI ID no.3913289
  misc_feature (1)..(370): Bit score of 1071.8 for HMM based on sequences of FIGURE 16.
  misc_feature (36)..(90): Pfam Name: Dimerisation Pfam Description: Dimerisation domain
  misc_feature (99)..(345): Pfam Name: Methyltransf_2 Pfam Description: O-methyltransferase
  misc_feature (99)..(345): Pfam Name: Methyltransf_2 Pfam Description: O-methyltransferase
  misc_feature (1)..(370): Bit score of 1071.8 for HMM based on sequences of FIGURE 16.
  misc_feature (1)..(370): Functional Homolog Of Ceres ANNOT ID no. 869790 at SEQ ID NO. 342

SEQ ID NO: 638 - protein, 368 aa, Clarkia breweri; identical to SEQ ID NO: 463
  misc_feature (1)..(368): Public GI ID no.38502831
  misc_feature (1)..(368): Bit score of 927.4 for HMM based on sequences of FIGURE 16.
  misc_feature (36)..(88): Pfam Name: Dimerisation Pfam Description: Dimerisation domain
  misc_feature (97)..(343): Pfam Name: Methyltransf_2 Pfam Description: O-methyltransferase
  misc_feature (97)..(343): Pfam Name: Methyltransf_2 Pfam Description: O-methyltransferase
  misc_feature (1)..(368): Bit score of 927.4 for HMM based on sequences of FIGURE 16.
  misc_feature (1)..(368): Functional Homolog Of Ceres ANNOT ID no. 869790 at SEQ ID NO. 342

SEQ ID NO: 639 - DNA, 1448 bp, Panicum virgatum
  misc_feature (1)..(1448): Ceres CLONE ID no.1869486
  misc_feature (1)..(1448): Encodes the peptide sequence at SEQ ID NO 640
cagcactggcgcacgccacttgactgttgcctctcgatcggtctcggcagctcaacgccggcaagaagccccccctagctcgccgccggcagctccaccactcgagcaggctgcagccagccatgggctccaccgccaccgacgtggccgcggccgcggacgaggaggcgtgcatgtacgcgctgcagctggcgtcgtcgtccatcctgccgatgacgctcaagaacgccatcgagctgggcctgctggaggtgctccagaaggaccccgcggcggcgctggcgccggaggaggtggtggcgcggctgcccgtgacgcccactaaccccgacgcggcgaccatggtcgaccgcatcctgcgcctgctcgcctcctacgacgtcgtccggtgccagatggaggagggcaaggacggcaagtactcgcgccgctacgccgccgcgcccgtctgcaagtggctcacccccaacgaggacggcgtctccatggccgccctcgcgctcatgaaccaggacaaggtcctcatggagagctggtactacctcaaggacgccgtgctggagggcggcatcccgttcaacaaggcgtacggcatgacggcgttcgagtaccacggcacggacccgcgcttcaaccgcgtgttcaacgagggcatgaagaaccactcggtgatcatcaccaagaagctgctcgagttctacaccggcttcgagggcgtcggcaccctggtcgacgtcggcggcggcatcggcgccaccctgcacgccatcacctcccactacccgcggataacgggggtcaacttcgacctgccccacgtgatctccgaggcgccgccgttccccggcgtgcagcacgtcggcggcgacatgttcaaggccgtgcccgccggcgacgccatcctcatgaagtggatcctccacgactggagcggcgcccactgcgcggtgatcctcaagaactgctacgacgcgctccccgccggcggcaaggtgatcatcgtcgagtgcatcctgccggtgaacccggaggcgacgcccaaggcgcagggcgtgttccacgccgacctcatcatgctcgcgcacaaccccggcggcaaggagcgctacgagagggagttcgaggagctcgccaagggcgccggcttcaccgggttcaaggccacctacatctacgccaacgcatgggccatcgagttcaccaagtagatctctgaagctgcttcctcgtgctgttgtcgcgcatgtgctttcgcttaatttgctttcttcttcttcatcatcatcatcctactggcctgcctgcctccatgtccatggccaccatcgatcttgttctggattccaaacgaactctaatggttgtatgtgttgagatgtctctaccatgtaccattaataacagccaaggtactcttatatatatacatacatacttaatatgatgac

SEQ ID NO: 640 - protein, 361 aa, Panicum virgatum
  misc_feature (1)..(361): Ceres CLONE ID no.1869486
  misc_feature (1)..(361): Bit score of 959.5 for HMM based on sequences of FIGURE 16.
  misc_feature (31)..(83): Pfam Name: Dimerisation Pfam Description: Dimerisation domain
  misc_feature (92)..(338): Pfam Name: Methyltransf_2 Pfam Description: O-methyltransferase
  misc_feature (92)..(338): Pfam Name: Methyltransf_2 Pfam Description: O-methyltransferase
  misc_feature (1)..(361): Bit score of 959.5 for HMM based on sequences of FIGURE 16.
  misc_feature (1)..(361): Functional Homolog Of Ceres ANNOT ID no. 869790 at SEQ ID NO. 342
MGSTATDVAAAADEEACMYALQLASSSILPMTLKNAIELGLLEVLQKDPAAALAPEEVVARLPVTPTNPDAATMVDRILRLLASYDVVRCQMEEGKDGKYSRRYAAAPVCKWLTPNEDGVSMAALALMNQDKVLMESWYYLKDAVLEGGIPFNKAYGMTAFEYHGTDPRFNRVFNEGMKNHSVIITKKLLEFYTGFEGVGTLVDVGGGIGATLHAITSHYPRITGVNFDLPHVISEAPPFPGVQHVGGDMFKAVPAGDAILMKWILHDWSGAHCAVILKNCYDALPAGGKVIIVECILPVNPEATPKAQGVFHADLIMLAHNPGGKERYEREFEELAKGAGFTGFKATYIYANAWAIEFTK

SEQ ID NO: 641 - protein, 361 aa, Ocimum basilicum; identical to SEQ ID NO: 466
  misc_feature (1)..(361): Public GI ID no.29839421
  misc_feature (1)..(361): Bit score of 1053.4 for HMM based on sequences of FIGURE 16.
  misc_feature (32)..(83): Pfam Name: Dimerisation Pfam Description: Dimerisation domain
  misc_feature (92)..(338): Pfam Name: Methyltransf_2 Pfam Description: O-methyltransferase
  misc_feature (92)..(338): Pfam Name: Methyltransf_2 Pfam Description: O-methyltransferase
  misc_feature (1)..(361): Bit score of 1053.4 for HMM based on sequences of FIGURE 16.
  misc_feature (1)..(361): Functional Homolog Of Ceres ANNOT ID no. 869790 at SEQ ID NO. 342

SEQ ID NO: 642 - protein, 361 aa, Ocimum basilicum; identical to SEQ ID NO: 467
  misc_feature (1)..(361): Public GI ID no.29839420
  misc_feature (1)..(361): Bit score of 1040.4 for HMM based on sequences of FIGURE 16.
  misc_feature (32)..(83): Pfam Name: Dimerisation Pfam Description: Dimerisation domain
  misc_feature (92)..(338): Pfam Name: Methyltransf_2 Pfam Description: O-methyltransferase
  misc_feature (92)..(338): Pfam Name: Methyltransf_2 Pfam Description: O-methyltransferase
  misc_feature (1)..(361): Bit score of 1040.4 for HMM based on sequences of FIGURE 16.
  misc_feature (1)..(361): Functional Homolog Of Ceres ANNOT ID no. 869790 at SEQ ID NO. 342

SEQ ID NO: 643 - protein, 361 aa, Oryza sativa subsp. indica; identical to SEQ ID NO: 468
  misc_feature (1)..(361): Public GI ID no.125560205
  misc_feature (1)..(361): Bit score of 929.1 for HMM based on sequences of FIGURE 16.
  misc_feature (24)..(82): Pfam Name: Dimerisation Pfam Description: Dimerisation domain
  misc_feature (91)..(338): Pfam Name: Methyltransf_2 Pfam Description: O-methyltransferase
  misc_feature (91)..(338): Pfam Name: Methyltransf_2 Pfam Description: O-methyltransferase
  misc_feature (1)..(361): Bit score of 929.1 for HMM based on sequences of FIGURE 16.
  misc_feature (1)..(361): Functional Homolog Of Ceres ANNOT ID no. 869790 at SEQ ID NO. 342

SEQ ID NO: 644 - protein, 361 aa, Oryza sativa subsp. japonica; identical to SEQ ID NO: 470
  misc_feature (1)..(361): Public GI ID no.125602246
  misc_feature (1)..(361): Bit score of 927.5 for HMM based on sequences of FIGURE 16.
  misc_feature (24)..(82): Pfam Name: Dimerisation Pfam Description: Dimerisation domain
  misc_feature (91)..(338): Pfam Name: Methyltransf_2 Pfam Description: O-methyltransferase
  misc_feature (91)..(338): Pfam Name: Methyltransf_2 Pfam Description: O-methyltransferase
  misc_feature (1)..(361): Bit score of 927.5 for HMM based on sequences of FIGURE 16.
  misc_feature (1)..(361): Functional Homolog Of Ceres ANNOT ID no. 869790 at SEQ ID NO. 342

SEQ ID NO: 645 - protein, 368 aa, Oryza sativa subsp. japonica; identical to SEQ ID NO: 469
  misc_feature (1)..(368): Public GI ID no.115474869
  misc_feature (1)..(368): Bit score of 941.0 for HMM based on sequences of FIGURE 16.
  misc_feature (31)..(89): Pfam Name: Dimerisation Pfam Description: Dimerisation domain
  misc_feature (98)..(345): Pfam Name: Methyltransf_2 Pfam Description: O-methyltransferase
  misc_feature (98)..(345): Pfam Name: Methyltransf_2 Pfam Description: O-methyltransferase
  misc_feature (1)..(368): Bit score of 941 for HMM based on sequences of FIGURE 16.
  misc_feature (1)..(368): Functional Homolog Of Ceres ANNOT ID no. 869790 at SEQ ID NO. 342

SEQ ID NO: 646 - protein, 367 aa, Glycyrrhiza echinata; identical to SEQ ID NO: 471
  misc_feature (1)..(367): Public GI ID no.1669591
  misc_feature (1)..(367): Bit score of 752.5 for HMM based on sequences of FIGURE 16.
  misc_feature (102)..(343): Pfam Name: Methyltransf_2 Pfam Description: O-methyltransferase
  misc_feature (39)..(93): Pfam Name: Dimerisation Pfam Description: Dimerisation domain
  misc_feature (1)..(367): Bit score of 752.5 for HMM based on sequences of FIGURE 16.
  misc_feature (1)..(367): Functional Homolog Of Ceres ANNOT ID no. 869790 at SEQ ID NO. 342

SEQ ID NO: 647 - protein, 350 aa, Coffea canephora; identical to SEQ ID NO: 473
  misc_feature (1)..(350): Public GI ID no.22652500
  misc_feature (1)..(350): Bit score of 1037.2 for HMM based on sequences of FIGURE 16.
  misc_feature (21)..(72): Pfam Name: Dimerisation Pfam Description: Dimerisation domain
  misc_feature (81)..(327): Pfam Name: Methyltransf_2 Pfam Description: O-methyltransferase
  misc_feature (81)..(327): Pfam Name: Methyltransf_2 Pfam Description: O-methyltransferase
  misc_feature (1)..(350): Bit score of 1037.2 for HMM based on sequences of FIGURE 16.
  misc_feature (1)..(350): Functional Homolog Of Ceres ANNOT ID no. 869790 at SEQ ID NO. 342

SEQ ID NO: 648 - protein, 359 aa, Vanilla planifolia
  misc_feature (1)..(359): Public GI ID no.89113191
  misc_feature (1)..(359): Bit score of 832.3 for HMM based on sequences of FIGURE 16.
  misc_feature (28)..(79): Pfam Name: Dimerisation Pfam Description: Dimerisation domain
  misc_feature (88)..(336): Pfam Name: Methyltransf_2 Pfam Description: O-methyltransferase
  misc_feature (1)..(359): Bit score of 832.3 for HMM based on sequences of FIGURE 16.
  misc_feature (1)..(359): Functional Homolog Of Ceres ANNOT ID no. 869790 at SEQ ID NO. 342
MGSIPKNQEEVDVCNYAQKLVSCVVLPMTLNAAIQLGLFEEIVAAGPGARLSAEELASRIGSTNPLAPALLHRILRLLASYSIVTSSEAADNDGRGTTIRYGAAPVCKYLTRNEDGVSLASISQLTNHKIAMESWYHVKDAVLHGGVPFNMAHGGLNEFEYHATDPSFSKVFNEAMRGHSVFIMRNILKVYRGFDEAKVMVDVCGGTGGTLGMITAKHPHIKGINFDLPHVIAQAPPLPGVEHVGGDVFASVPSGDTVLLKWVLHDWNDEDCVRILKNCKKAIPETGKVVVVESVVPESLESSDLAHFILHSDLVMLLESPCGKERTKKDFRSLAQQSGFSGFAVLCSFSSSWVMEFTN

SEQ ID NO: 649 - protein, 359 aa, Vanilla planifolia
  misc_feature (1)..(359): Public GI ID no.89113193
  misc_feature (1)..(359): Bit score of 806.9 for HMM based on sequences of FIGURE 16.
  misc_feature (28)..(79): Pfam Name: Dimerisation Pfam Description: Dimerisation domain
  misc_feature (92)..(336): Pfam Name: Methyltransf_2 Pfam Description: O-methyltransferase
  misc_feature (1)..(359): Bit score of 806.9 for HMM based on sequences of FIGURE 16.
  misc_feature (1)..(359): Functional Homolog Of Ceres ANNOT ID no. 869790 at SEQ ID NO. 342
MGSIPNNHAEVDVCNYALKLVSSAVLPMTLNSAIQLGLLEEIVAAGPGARLSAEELASRIGSTNPLAPALLDRILRLLASYSIVTSYEAADTDGRGTTTRYGAAPVCKYLTRNEDGVSLASLSQLTNHKIAMESWYHVKDAVLHGGVPFNMAHGGLNEFEYHATDPSFSKVFNEAMRGHSVVIMRNILKVYRGLDEAKVMVDVCGGTGGTLGMITAKHPHIKGINFDLPHVIAQAPPLPGVEHVGGDVFASVPTGDTVLLKWVLHDWNDEDCVRILKNCKKAIPETGKVVVVESVVPESLESSDLAHFILHSDLVMLLESPFGKERTKKDFRSLAQQSGFSGFAVLCSFSSAWVMEFTN

SEQ ID NO: 650 - protein, 365 aa, Acacia mangium x Acacia auriculiformis; identical to SEQ ID NO: 476
  misc_feature (1)..(365): Public GI ID no.68159362
  misc_feature (1)..(365): Bit score of 1066.7 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1066.7 for HMM based on sequences of FIGURE 16.
  misc_feature (1)..(365): Functional Homolog Of Ceres ANNOT ID no. 869790 at SEQ ID NO. 342

SEQ ID NO: 651 - protein, 365 aa, Rosa chinensis; identical to SEQ ID NO: 477
  misc_feature (1)..(365): Public GI ID no.29839344
  misc_feature (1)..(365): Bit score of 1092.2 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1092.2 for HMM based on sequences of FIGURE 16.
  misc_feature (1)..(365): Functional Homolog Of Ceres ANNOT ID no. 869790 at SEQ ID NO. 342

SEQ ID NO: 652 - protein, 362 aa, Thalictrum tuberosum; identical to SEQ ID NO: 479
  misc_feature (1)..(362): Public GI ID no.4808524
  misc_feature (1)..(362): Bit score of 1020.0 for HMM based on sequences of FIGURE 16.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(362): Bit score of 1020 for HMM based on sequences of FIGURE 16.
  misc_feature (1)..(362): Functional Homolog Of Ceres ANNOT ID no. 869790 at SEQ ID NO. 342

SEQ ID NO: 653 - protein, 362 aa, Thalictrum tuberosum; identical to SEQ ID NO: 482
  misc_feature (1)..(362): Public GI ID no.4808526
  misc_feature (1)..(362): Bit score of 1012.9 for HMM based on sequences of FIGURE 16.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(362): Bit score of 1012.9 for HMM based on sequences of FIGURE 16.
  misc_feature (1)..(362): Functional Homolog Of Ceres ANNOT ID no. 869790 at SEQ ID NO. 342

SEQ ID NO: 654 - protein, 362 aa, Thalictrum tuberosum; identical to SEQ ID NO: 478
  misc_feature (1)..(362): Public GI ID no.4808530
  misc_feature (1)..(362): Bit score of 1011.8 for HMM based on sequences of FIGURE 16.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(362): Bit score of 1011.8 for HMM based on sequences of FIGURE 16.
  misc_feature (1)..(362): Functional Homolog Of Ceres ANNOT ID no. 869790 at SEQ ID NO. 342

SEQ ID NO: 655 - protein, 364 aa, Thalictrum tuberosum; identical to SEQ ID NO: 481
  misc_feature (1)..(364): Public GI ID no.4808528
  misc_feature (1)..(364): Bit score of 1019.8 for HMM based on sequences of FIGURE 16.
  misc_feature (35)..(86): Pfam Name: Dimerisation Pfam Description: Dimerisation domain
  misc_feature (95)..(341): Pfam Name: Methyltransf_2 Pfam Description: O-methyltransferase
  misc_feature (95)..(341): Pfam Name: Methyltransf_2 Pfam Description: O-methyltransferase
  misc_feature (1)..(364): Bit score of 1019.8 for HMM based on sequences of FIGURE 16.
  misc_feature (1)..(364): Functional Homolog Of Ceres ANNOT ID no. 869790 at SEQ ID NO. 342

SEQ ID NO: 656 - protein, 364 aa, Thalictrum tuberosum; identical to SEQ ID NO: 480
  misc_feature (1)..(364): Public GI ID no.4808522
  misc_feature (1)..(364): Bit score of 1016.6 for HMM based on sequences of FIGURE 16.
  misc_feature (35)..(86): Pfam Name: Dimerisation Pfam Description: Dimerisation domain
  misc_feature (95)..(341): Pfam Name: Methyltransf_2 Pfam Description: O-methyltransferase
  misc_feature (95)..(341): Pfam Name: Methyltransf_2 Pfam Description: O-methyltransferase
  misc_feature (1)..(364): Bit score of 1016.6 for HMM based on sequences of FIGURE 16.
  misc_feature (1)..(364): Functional Homolog Of Ceres ANNOT ID no. 869790 at SEQ ID NO. 342

SEQ ID NO: 657 - protein, 359 aa, Capsicum chinense; identical to SEQ ID NO: 483
  misc_feature (1)..(359): Public GI ID no.29839258
  misc_feature (1)..(359): Bit score of 1021.1 for HMM based on sequences of FIGURE 16.
  misc_feature (30)..(81): Pfam Name: Dimerisation Pfam Description: Dimerisation domain
  misc_feature (90)..(336): Pfam Name: Methyltransf_2 Pfam Description: O-methyltransferase
  misc_feature (90)..(336): Pfam Name: Methyltransf_2 Pfam Description: O-methyltransferase
  misc_feature (1)..(359): Bit score of 1021.1 for HMM based on sequences of FIGURE 16.
  misc_feature (1)..(359): Functional Homolog Of Ceres ANNOT ID no. 869790 at SEQ ID NO. 342

SEQ ID NO: 658 - protein, 365 aa, Boehmeria nivea; identical to SEQ ID NO: 484
  misc_feature (1)..(365): Public GI ID no.109255537
  misc_feature (1)..(365): Bit score of 1088.5 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1088.5 for HMM based on sequences of FIGURE 16.
  misc_feature (1)..(365): Functional Homolog Of Ceres ANNOT ID no. 869790 at SEQ ID NO. 342

SEQ ID NO: 659 - protein, 376 aa, Hordeum vulgare subsp. vulgare
  misc_feature (1)..(376): Public GI ID no.1314742
  misc_feature (1)..(376): Bit score of 709.6 for HMM based on sequences of FIGURE 16.
  misc_feature (105)..(352): Pfam Name: Methyltransf_2 Pfam Description: O-methyltransferase
  misc_feature (43)..(95): Pfam Name: Dimerisation Pfam Description: Dimerisation domain
  misc_feature (1)..(376): Bit score of 709.6 for HMM based on sequences of FIGURE 16.
  misc_feature (1)..(376): Functional Homolog Of Ceres ANNOT ID no. 869790 at SEQ ID NO. 342
MDKISAPFFSGTSPAAASVAGVDEDDRLCFQAQELMFAYNISMVLRAAIQLGLLDALSAAGGKALTPNELVENVETSSNKAEAAAAVDRILRYLSCFNVVTCSSEAAGPDGTLVRRYTTGPLCRWLTKDRGDGTLSPFAVFVVDPDHLFPWHHIAEAVTAGGPSAFERTQKWPYYEYMGKNQRLGTLFDNAMAQHSVILVTKMLERFKGFDGVQRLVDVGGGTGSTLGMITSKYKHMTGINYDLPHVIAQGLPLPGVEHVAGDMYESIPTGDAVLLQWITLMLNDDEFVKILSNCHNALPKDGKVIVVDGILPENPDSSLTARDAFTLDIIMFVLFKGAKQRTEKEFARLAKQAGFTGGIKKTYIFFNFYALEFTK

SEQ ID NO: 660 - protein, 360 aa, Populus tomentosa; identical to SEQ ID NO: 486
  misc_feature (1)..(360): Public GI ID no.7528266
  misc_feature (1)..(360): Bit score of 1079.8 for HMM based on sequences of FIGURE 16.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(360): Bit score of 1079.8 for HMM based on sequences of FIGURE 16.
  misc_feature (1)..(360): Functional Homolog Of Ceres ANNOT ID no. 869790 at SEQ ID NO. 342

SEQ ID NO: 661 - protein, 362 aa, Saccharum hybrid cultivar; identical to SEQ ID NO: 487
  misc_feature (1)..(362): Public GI ID no.34398680
  misc_feature (1)..(362): Bit score of 964.3 for HMM based on sequences of FIGURE 16.
  misc_feature (31)..(85): Pfam Name: Dimerisation Pfam Description: Dimerisation domain
  misc_feature (94)..(339): Pfam Name: Methyltransf_2 Pfam Description: O-methyltransferase
  misc_feature (94)..(339): Pfam Name: Methyltransf_2 Pfam Description: O-methyltransferase
  misc_feature (1)..(362): Bit score of 964.3 for HMM based on sequences of FIGURE 16.
  misc_feature (1)..(362): Functional Homolog Of Ceres ANNOT ID no. 869790 at SEQ ID NO. 342

SEQ ID NO: 662 - protein, 355 aa, Thalictrum flavum subsp. glaucum; identical to SEQ ID NO: 489
  misc_feature (1)..(355): Public GI ID no.51980212
  misc_feature (1)..(355): Bit score of 711.7 for HMM based on sequences of FIGURE 16.
  misc_feature (23)..(74): Pfam Name: Dimerisation Pfam Description: Dimerisation domain
  misc_feature (84)..(325): Pfam Name: Methyltransf_2 Pfam Description: O-methyltransferase
  misc_feature (1)..(355): Bit score of 711.7 for HMM based on sequences of FIGURE 16.
  misc_feature (1)..(355): Functional Homolog Of Ceres ANNOT ID no. 869790 at SEQ ID NO. 342

SEQ ID NO: 663 - protein, 363 aa, Isatis indigotica; identical to SEQ ID NO: 490
  misc_feature (1)..(363): Public GI ID no.74053618
  misc_feature (1)..(363): Bit score of 926.8 for HMM based on sequences of FIGURE 16.
  misc_feature (33)..(82): Pfam Name: Dimerisation Pfam Description: Dimerisation domain
  misc_feature (93)..(338): Pfam Name: Methyltransf_2 Pfam Description: O-methyltransferase
  misc_feature (1)..(363): Bit score of 926.8 for HMM based on sequences of FIGURE 16.
  misc_feature (1)..(363): Functional Homolog Of Ceres ANNOT ID no. 869790 at SEQ ID NO. 342

SEQ ID NO: 664 - protein, 371 aa, Rosa chinensis var. spontanea
  misc_feature (1)..(371): Public GI ID no.47232556
  misc_feature (1)..(371): Bit score of 936.7 for HMM based on sequences of FIGURE 16.
  misc_feature (100)..(348): Pfam Name: Methyltransf_2 Pfam Description: O-methyltransferase
  misc_feature (40)..(91): Pfam Name: Dimerisation Pfam Description: Dimerisation domain
  misc_feature (1)..(371): Bit score of 936.7 for HMM based on sequences of FIGURE 16.
  misc_feature (1)..(371): Functional Homolog Of Ceres ANNOT ID no. 869790 at SEQ ID NO. 342
MRSTSPQTIDSTPMSHPQQEEEEELGKQAIRLANVVILPMVLKSALELNVIDIIWGAGDGESLSPSDIAAQLPTKNSNAPAVLDRMLRLLASHSILKCSARTGSDGQVERLYSAGPICKFLVKDQNGGTRSVGPLFLLHHDKVFMEGWFHLNDAILEGGIPFNRAYGMTAFEYPETDERFNRVFNQAMSNHTTLILKKILDVYRGFEGINVLVDVGGGIGVTLNLITNKYPHIKGINFDLPHVLADAPSYPGVEHVGGDMFKSVPQGDAIFMKWILHDWSDEHCLTLLKNCCKSLPSSGKVIFVESILPEVPDSTVTSNIVCEQDLLMFTQNPGGKERTKKEYEALALKSGFSRLEVVCSAYNSWVMEFHK

SEQ ID NO: 665 - protein, 364 aa, Picea abies; identical to SEQ ID NO: 378
  misc_feature (1)..(364): Public GI ID no.56605372
  misc_feature (1)..(364): Bit score of 909.5 for HMM based on sequences of FIGURE 17.
  misc_feature (34)..(85): Pfam Name: Dimerisation Pfam Description: Dimerisation domain
  misc_feature (95)..(340): Pfam Name: Methyltransf_2 Pfam Description: O-methyltransferase
  misc_feature (95)..(340): Pfam Name: Methyltransf_2 Pfam Description: O-methyltransferase
  misc_feature (1)..(364): Bit score of 909.5 for HMM based on sequences of FIGURE 17.
  misc_feature (1)..(364): Functional Homolog Of Ceres ANNOT ID no. 869854 at SEQ ID NO. 342

SEQ ID NO: 666 - protein, 382 aa, Pinus radiata; identical to SEQ ID NO: 379
  misc_feature (1)..(382): Public GI ID no.4574324
  misc_feature (1)..(382): Bit score of 698.7 for HMM based on sequences of FIGURE 17.
  misc_feature (104)..(358): Pfam Name: Methyltransf_2 Pfam Description: O-methyltransferase
  misc_feature (104)..(358): Pfam Name: Methyltransf_2 Pfam Description: O-methyltransferase
  misc_feature (46)..(96): Pfam Name: Dimerisation Pfam Description: Dimerisation domain
  misc_feature (1)..(382): Bit score of 698.7 for HMM based on sequences of FIGURE 17.
  misc_feature (1)..(382): Functional Homolog Of Ceres ANNOT ID no. 869854 at SEQ ID NO. 342

SEQ ID NO: 667 - protein, 382 aa, Pinus radiata; identical to SEQ ID NO: 380
  misc_feature (1)..(382): Public GI ID no.1568664
  misc_feature (1)..(382): Bit score of 689.6 for HMM based on sequences of FIGURE 17.
  misc_feature (104)..(358): Pfam Name: Methyltransf_2 Pfam Description: O-methyltransferase
  misc_feature (104)..(358): Pfam Name: Methyltransf_2 Pfam Description: O-methyltransferase
  misc_feature (46)..(96): Pfam Name: Dimerisation Pfam Description: Dimerisation domain
  misc_feature (1)..(382): Bit score of 689.6 for HMM based on sequences of FIGURE 17.
  misc_feature (1)..(382): Functional Homolog Of Ceres ANNOT ID no. 869854 at SEQ ID NO. 342

SEQ ID NO: 668 - protein, 381 aa, Pinus taeda
  misc_feature (1)..(381): Public GI ID no.1777386
  misc_feature (1)..(381): Bit score of 689.9 for HMM based on sequences of FIGURE 17.
  misc_feature (106)..(357): Pfam Name: Methyltransf_2 Pfam Description: O-methyltransferase
  misc_feature (106)..(357): Pfam Name: Methyltransf_2 Pfam Description: O-methyltransferase
  misc_feature (46)..(96): Pfam Name: Dimerisation Pfam Description: Dimerisation domain
  misc_feature (1)..(381): Bit score of 689.9 for HMM based on sequences of FIGURE 17.
  misc_feature (1)..(381): Functional Homolog Of Ceres ANNOT ID no. 869854 at SEQ ID NO. 342
MDSNMNGLAKSNGCEISRDGFFESEEEELQGQAEAWKCTFAFAESLAVKCVVLLGIPDMIAREGPRATLSLCEIVANLPTESPDAACLFRIMRFLVAKGIFPASKSARRRAFETRYGLTPASKWLVKGRELSMAPMLLMQNDETTLAPWHHFNECVLEGGVAFQKANGAEIWSYASDHPDFNNLFNNAMACNARIVMKAILSKYQGFHSLNSLVDVGGGTGTAVAEIVRAYPFIRGINYDLPHVVATASSLSGVQHVGGDMFETVPTADAIFMKWIMHDWNDEDCIKILKNCRKAIPDTGKVIIVDVVLDADQGDNTDKKRKKAVDPIVGTVFDLVMVAHSSGGKERTEKEWKRILLEGGFSRYNIIEIPALQSVIEAFPR

SEQ ID NO: 669 - protein, 381 aa, Coptis japonica; identical to SEQ ID NO: 381
  misc_feature (1)..(381): Public GI ID no.24212392
  misc_feature (1)..(381): Bit score of 721.5 for HMM based on sequences of FIGURE 17.
  misc_feature (114)..(355): Pfam Name: Methyltransf_2 Pfam Description: O-methyltransferase
  misc_feature (53)..(104): Pfam Name: Dimerisation Pfam Description: Dimerisation domain
  misc_feature (1)..(381): Bit score of 721.5 for HMM based on sequences of FIGURE 17.
  misc_feature (1)..(381): Functional Homolog Of Ceres ANNOT ID no. 869854 at SEQ ID NO. 342

SEQ ID NO: 670 - protein, 353 aa, Eschscholzia californica
  misc_feature (1)..(353): Public GI ID no.87887871
  misc_feature (1)..(353): Bit score of 609.1 for HMM based on sequences of FIGURE 17.
  misc_feature (23)..(73): Pfam Name: Dimerisation Pfam Description: Dimerisation domain
  misc_feature (91)..(329): Pfam Name: Methyltransf_2 Pfam Description: O-methyltransferase
  misc_feature (1)..(353): Bit score of 609.1 for HMM based on sequences of FIGURE 17.
  misc_feature (1)..(353): Functional Homolog Of Ceres ANNOT ID no. 869854 at SEQ ID NO. 342
MDEEIILGQADICKYMYGFVDSMTLRCVVELGIPDIIHSHGRPITLTEILNGIPNLSSSFDINYLQGIMTILVRRRVFAVHKFDPKDGTNLTEIRYGLTPSSKCLLKDSKFNLAPFVLLETHPWITDPWNYLGKCVQEGGSGFVKAHGSDVFKFGSDHPEFFKLFYDGMECSTKVLVQVVLDKYQQVFKDVKSIVDVGGGTGMMISEIVKNHPHIKGINFDLPHVVAEAPDYPGVEHVGGDMFVEIPQADAITMKGILHDWNDDACVKILENCKKAIPKNGKVIIIDCVLNPDGDDLFDDIKVVSDLGMRVHCSDGKERTEAEWEKLLKKGGFPRYKITHVVTVQSMIEAYPE

SEQ ID NO: 671 - protein, 360 aa, Papaver somniferum; identical to SEQ ID NO: 382
  misc_feature (1)..(360): Public GI ID no.33286376
  misc_feature (1)..(360): Bit score of 953.5 for HMM based on sequences of FIGURE 17.
  misc_feature (28)..(80): Pfam Name: Dimerisation Pfam Description: Dimerisation domain
  misc_feature (89)..(336): Pfam Name: Methyltransf_2 Pfam Description: O-methyltransferase
  misc_feature (89)..(336): Pfam Name: Methyltransf_2 Pfam Description: O-methyltransferase
  misc_feature (1)..(360): Bit score of 953.5 for HMM based on sequences of FIGURE 17.
  misc_feature (1)..(360): Functional Homolog Of Ceres ANNOT ID no. 869854 at SEQ ID NO. 342

SEQ ID NO: 672 - protein, 365 aa, Mesembryanthemum crystallinum; identical to SEQ ID NO: 577
  misc_feature (1)..(365): Public GI ID no.1170555
  misc_feature (1)..(365): Bit score of 823.9 for HMM based on sequences of FIGURE 17.
  misc_feature (36)..(87): Pfam Name: Dimerisation Pfam Description: Dimerisation domain
  misc_feature (96)..(341): Pfam Name: Methyltransf_2 Pfam Description: O-methyltransferase
  misc_feature (96)..(341): Pfam Name: Methyltransf_2 Pfam Description: O-methyltransferase
  misc_feature (1)..(365): Bit score of 823.9 for HMM based on sequences of FIGURE 17.
  misc_feature (1)..(365): Functional Homolog Of Ceres ANNOT ID no. 869854 at SEQ ID NO. 342

SEQ ID NO: 673 - DNA, 1415 bp, Gossypium hirsutum; identical to SEQ ID NO: 578
  misc_feature (1)..(1415): Ceres CLONE ID no.1838010
  misc_feature (1)..(1415): Encodes the peptide sequence at SEQ ID NO 674

SEQ ID NO: 674 - protein, 365 aa, Gossypium hirsutum; identical to SEQ ID NO: 579
  misc_feature (1)..(365): Ceres CLONE ID no.1838010
  misc_feature (1)..(365): Bit score of 1039.2 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1039.2 for HMM based on sequences of FIGURE 17.
  misc_feature (1)..(365): Functional Homolog Of Ceres ANNOT ID no. 869854 at SEQ ID NO. 342

SEQ ID NO: 675 - DNA, 1351 bp, Gossypium hirsutum
  misc_feature (1)..(1351): Ceres CLONE ID no.1847526
  misc_feature (1)..(1351): Encodes the peptide sequence at SEQ ID NO 676
aatatcccaaaacaatgggttcaaccggtgaaacccaaatgactcccacccaagtctcggatgaggaagccaacttattcgccatgcaactcaccagtgcctcagtccttccgatggtcctcaagtcggccatagaacttgacctgctggagatcatggccaaagctggcccaggtgctttcctctccccaaaagaattggcttcccagctccccaccaacaaccccgatgcacctgtcatgctagaccgcatcttgcgcctcctggctacctactccatcctcacttgctccttgcgcactcttcctgatggcaaagtggagagactctatggtcttggccctgtctgcaaattcttgaccaagaatgaagatggcgtcactctttccgccctcagtctcatgaatcaagacaaggtccttatggagagctggtactacttgaaagatgccgtgctggaaggtggaattcccttcaacaaagcctatggtatgaccgcattcgagtatcatggcacggatcctagattcaacaaggttttcaacaggggaatgtctgatcactctaccattaccatgaagaagattcttgagacctatgatggctttgagggactcaaaacactggtcgatgttggcggcggtactggagctacgcttaacatgcttgtcaccaagcacccttctataaagggcatcaactttgatttgcctcatgtcattgaggatgctcctgcttatcctggtgtggagcatgttggtggagacatgtttgaaagtgttccaaaaggagacgccatcttcatgaagtggatatgccacgattggagcgatgagcactgctccaagtttttgaagaagtgctacgaagctttaccggacaacggaaaagtaattgtcgcagaatgtattctcccagattacccagatcctagccttgacacaaagttagttgtccatattgattgcatcatgttggctcacaatcctggtgggaaagagaggactgagaaagaattcgaggccttggcaaggagtgctgggtttcaaggtttccaagtaaaatgctgcgctttcggcacatacatcatggagtttctcaaaagggtttgaactttgaatctatgtgttttggttacatgcttcacactgttatttgggcgattgtctcaaaggtggcttgcacacagaaaacaaataaggacgagattttgtgctgcttgtgtatgataaatactgttttatacgtatgcttataattctatcctggcctcaatgtaaactaataagcaaatgttgattaatgtcataaaacctcgagtttgagaaaacaaaaaaaaaaaaaaaaaaaa

SEQ ID NO: 676 - protein, 365 aa, Gossypium hirsutum
  misc_feature (1)..(365): Ceres CLONE ID no.1847526
  misc_feature (1)..(365): Bit score of 1055.6 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1055.6 for HMM based on sequences of FIGURE 17.
  misc_feature (1)..(365): Functional Homolog Of Ceres ANNOT ID no. 869854 at SEQ ID NO. 342
MGSTGETQMTPTQVSDEEANLFAMQLTSASVLPMVLKSAIELDLLEIMAKAGPGAFLSPKELASQLPTNNPDAPVMLDRILRLLATYSILTCSLRTLPDGKVERLYGLGPVCKFLTKNEDGVTLSALSLMNQDKVLMESWYYLKDAVLEGGIPFNKAYGMTAFEYHGTDPRFNKVFNRGMSDHSTITMKKILETYDGFEGLKTLVDVGGGTGATLNMLVTKHPSIKGINFDLPHVIEDAPAYPGVEHVGGDMFESVPKGDAIFMKWICHDWSDEHCSKFLKKCYEALPDNGKVIVAECILPDYPDPSLDTKLVVHIDCIMLAHNPGGKERTEKEFEALARSAGFQGFQVKCCAFGTYIMEFLKRV

SEQ ID NO: 677 - protein, 365 aa, Populus tremuloides; identical to SEQ ID NO: 388
  misc_feature (1)..(365): Public GI ID no.231757
  misc_feature (1)..(365): Bit score of 1075.4 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1075.4 for HMM based on sequences of FIGURE 17.
  misc_feature (1)..(365): Functional Homolog Of Ceres ANNOT ID no. 869854 at SEQ ID NO. 342

SEQ ID NO: 678 - protein, 364 aa, Populus tremuloides; identical to SEQ ID NO: 581
  misc_feature (1)..(364): Public GI ID no.29839286
  misc_feature (1)..(364): Bit score of 994.2 for HMM based on sequences of FIGURE 17.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(364): Bit score of 994.2 for HMM based on sequences of FIGURE 17.
  misc_feature (1)..(364): Functional Homolog Of Ceres ANNOT ID no. 869854 at SEQ ID NO. 342

SEQ ID NO: 679 - DNA, 1095 bp, Populus balsamifera subsp. trichocarpa; identical to SEQ ID NO: 582
  misc_feature (1)..(1095): Ceres ANNOT ID no.1521032
  misc_feature (1)..(1095): Encodes the peptide sequence at SEQ ID NO 680

SEQ ID NO: 680 - protein, 356 aa, Populus balsamifera subsp. trichocarpa; identical to SEQ ID NO: 583
  misc_feature (1)..(356): Ceres ANNOT ID no.1521032
  misc_feature (1)..(356): Bit score of 1046.7 for HMM based on sequences of FIGURE 17.
  misc_feature (26)..(77): Pfam Name: Dimerisation Pfam Description: Dimerisation domain
  misc_feature (86)..(332): Pfam Name: Methyltransf_2 Pfam Description: O-methyltransferase
  misc_feature (86)..(332): Pfam Name: Methyltransf_2 Pfam Description: O-methyltransferase
  misc_feature (1)..(356): Bit score of 1046.7 for HMM based on sequences of FIGURE 17.
  misc_feature (1)..(356): Functional Homolog Of Ceres ANNOT ID no. 869854 at SEQ ID NO. 342

SEQ ID NO: 681 - DNA, 1095 bp, Populus balsamifera subsp. trichocarpa; identical to SEQ ID NO: 584
  misc_feature (1)..(1095): Ceres ANNOT ID no.1472909
  misc_feature (1)..(1095): Encodes the peptide sequence at SEQ ID NO 682

SEQ ID NO: 682 - protein, 364 aa, Populus balsamifera subsp. trichocarpa; identical to SEQ ID NO: 585
  misc_feature (1)..(364): Ceres ANNOT ID no.1472909
  misc_feature (1)..(364): Bit score of 1013.8 for HMM based on sequences of FIGURE 17.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(364): Bit score of 1013.8 for HMM based on sequences of FIGURE 17.
  misc_feature (1)..(364): Functional Homolog Of Ceres ANNOT ID no. 869854 at SEQ ID NO. 342

SEQ ID NO: 683 - protein, 364 aa, Populus x generosa; identical to SEQ ID NO: 391
  misc_feature (1)..(364): Public GI ID no.7332271
  misc_feature (1)..(364): Bit score of 1069.9 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(364): Bit score of 1069.9 for HMM based on sequences of FIGURE 17.
  misc_feature (1)..(364): Functional Homolog Of Ceres ANNOT ID no. 869854 at SEQ ID NO. 342

SEQ ID NO: 684 - protein, 364 aa, Populus x generosa; identical to SEQ ID NO: 392
  misc_feature (1)..(364): Public GI ID no.444327
  misc_feature (1)..(364): Bit score of 1064.9 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(364): Bit score of 1064.9 for HMM based on sequences of FIGURE 17.
  misc_feature (1)..(364): Functional Homolog Of Ceres ANNOT ID no. 869854 at SEQ ID NO. 342

SEQ ID NO: 685 - protein, 381 aa, Arabidopsis thaliana; identical to SEQ ID NO: 193
  misc_feature (1)..(381): Public GI ID no.27808586
  misc_feature (1)..(381): Bit score of 747.6 for HMM based on sequences of FIGURE 17.
  misc_feature (111)..(358): Pfam Name: Methyltransf_2 Pfam Description: O-methyltransferase
  misc_feature (44)..(97): Pfam Name: Dimerisation Pfam Description: Dimerisation domain
  misc_feature (1)..(381): Bit score of 747.6 for HMM based on sequences of FIGURE 17.
  misc_feature (1)..(381): Functional Homolog Of Ceres ANNOT ID no. 869854 at SEQ ID NO. 342

SEQ ID NO: 686 - DNA, 1229 bp, Arabidopsis thaliana
  misc_feature (1)..(1229): Ceres CLONE ID no.3828
  misc_feature (1)..(1229): Encodes the peptide sequence at SEQ ID NO 687
acattaatttcttataaccaacaacaataatgacaaaccatcttcaagatcccttacctacttacccaaaaccggttttaaccaaagaagaacaagaagtggacgagaaaatggtaagcttgcaagcagagagtatcgtgaaacaccgtggctttccctatggttctcaaagccgccttcgagcttggcgtcatcgacaccatcgctgctgcaggaaacgacacgtggctctcaccgtgtgagatagcgtgtagtctcccaaccaaacccaccaacccggaggcgccggtgttgcttgaccggatgctgagcttacttgtcagccactcgatcttgaagtgccgtatgattgaaaccggagagaacggtcgaaccggaaagatcgagagggtatatgcagccgaaccggtttgcaagtattttttgagagatagtgatggtacaggatctctcgtgcctctgttcatgttgctccatacccaagtgtttttcaagacttggacaaatcttaaagatgtgatactagaaggaagagatgcattcaactctgcccacggcatgaaaatcttcgaatacataaattcggatcaaccatttgctgagttgtttaatcgtgcaatgtcggaaccttccaccatgatcatgaagaaggttctagacgtatatagaggatttgaagatgttaacactttggtggatgttggaggaggaaatggcactgttttaggtttagtcacttctaagtatcctcatatcaaaggtgttaatttcgacttagctcaagttttaacccaagctcctttttatccaggagtcgagcatgtatctggagacatgtttgtagaagttccaaagggagatgccgtctttatgaaatggatactacatgattggggagacgaggattgtataaagattctgaaaaattgttggaaaagtctaccggaaaaagggaagattattattgtagagtttgttacaccaaaggaaccaaagggtggtgacttatcttctaacactgtctttgccatggacttgttgatgttaacccaatgctctggtggtaaagagagatctctttcacagttcgagaatttggcgtttgcgtcaggttttcttcgatgtgaaatcatttgtcttgcttattcgtattctgttatcgaattccacaaataaatttggaatttaagaaagaaaagaaaacaatatatacgtaactttttctgttt

SEQ ID NO: 687 - protein, 338 aa, Arabidopsis thaliana
  misc_feature (1)..(338): Ceres CLONE ID no.3828
  misc_feature (1)..(338): Bit score of 687.8 for HMM based on sequences of FIGURE 17.
  misc_feature (1)..(54): Pfam Name: Dimerisation Pfam Description: Dimerisation domain
  misc_feature (68)..(315): Pfam Name: Methyltransf_2 Pfam Description: O-methyltransferase
  misc_feature (1)..(338): Bit score of 687.8 for HMM based on sequences of FIGURE 17.
  misc_feature (1)..(338): Functional Homolog Of Ceres ANNOT ID no. 869854 at SEQ ID NO. 342
MVLKAAFELGVIDTIAAAGNDTWLSPCEIACSLPTKPTNPEAPVLLDRMLSLLVSHSILKCRMIETGENGRTGKIERVYAAEPVCKYFLRDSDGTGSLVPLFMLLHTQVFFKTWTNLKDVILEGRDAFNSAHGMKIFEYINSDQPFAELFNRAMSEPSTMIMKKVLDVYRGFEDVNTLVDVGGGNGTVLGLVTSKYPHIKGVNFDLAQVLTQAPFYPGVEHVSGDMFVEVPKGDAVFMKWILHDWGDEDCIKILKNCWKSLPEKGKIIIVEFVTPKEPKGGDLSSNTVFAMDLLMLTQCSGGKERSLSQFENLAFASGFLRCEIICLAYSYSVIEFHK

SEQ ID NO: 688 - DNA, 1326 bp, Brassica napus; identical to SEQ ID NO: 591
  misc_feature (1)..(1326): Ceres CLONE ID no.1086143
  misc_feature (1)..(1326): Encodes the peptide sequence at SEQ ID NO 689

SEQ ID NO: 689 - protein, 364 aa, Brassica napus; identical to SEQ ID NO: 592
  misc_feature (1)..(364): Ceres CLONE ID no.1086143
  misc_feature (1)..(364): Bit score of 992.9 for HMM based on sequences of FIGURE 17.
  misc_feature (34)..(83): Pfam Name: Dimerisation Pfam Description: Dimerisation domain
  misc_feature (94)..(339): Pfam Name: Methyltransf_2 Pfam Description: O-methyltransferase
  misc_feature (94)..(339): Pfam Name: Methyltransf_2 Pfam Description: O-methyltransferase
  misc_feature (1)..(364): Bit score of 992.9 for HMM based on sequences of FIGURE 17.
  misc_feature (1)..(364): Functional Homolog Of Ceres ANNOT ID no. 869854 at SEQ ID NO. 342

SEQ ID NO: 690 - DNA, 1368 bp, Brassica napus; identical to SEQ ID NO: 398
  misc_feature (1)..(1368): Ceres CLONE ID no.1118817
  misc_feature (1)..(1368): Encodes the peptide sequence at SEQ ID NO 691

SEQ ID NO: 691 - protein, 364 aa, Brassica napus; identical to SEQ ID NO: 399
  misc_feature (1)..(364): Ceres CLONE ID no.1118817
  misc_feature (1)..(364): Bit score of 972.1 for HMM based on sequences of FIGURE 17.
  misc_feature (34)..(83): Pfam Name: Dimerisation Pfam Description: Dimerisation domain
  misc_feature (94)..(339): Pfam Name: Methyltransf_2 Pfam Description: O-methyltransferase
  misc_feature (94)..(339): Pfam Name: Methyltransf_2 Pfam Description: O-methyltransferase
  misc_feature (1)..(364): Bit score of 972.1 for HMM based on sequences of FIGURE 17.
  misc_feature (1)..(364): Functional Homolog Of Ceres ANNOT ID no. 869854 at SEQ ID NO. 342

SEQ ID NO: 692 - protein, 365 aa, Fragaria x ananassa; identical to SEQ ID NO: 402
  misc_feature (1)..(365): Public GI ID no.6760443
  misc_feature (1)..(365): Bit score of 1055.9 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1055.9 for HMM based on sequences of FIGURE 17.
  misc_feature (1)..(365): Functional Homolog Of Ceres ANNOT ID no. 869854 at SEQ ID NO. 342

SEQ ID NO: 693 - protein, 365 aa, Malus x domestica; identical to SEQ ID NO: 404
  misc_feature (1)..(365): Public GI ID no.114199044
  misc_feature (1)..(365): Bit score of 1051.5 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1051.5 for HMM based on sequences of FIGURE 17.
  misc_feature (1)..(365): Functional Homolog Of Ceres ANNOT ID no. 869854 at SEQ ID NO. 342

SEQ ID NO: 694 - protein, 365 aa, Malus x domestica; identical to SEQ ID NO: 405
  misc_feature (1)..(365): Public GI ID no.114199046
  misc_feature (1)..(365): Bit score of 1008.0 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1008 for HMM based on sequences of FIGURE 17.
  misc_feature (1)..(365): Functional Homolog Of Ceres ANNOT ID no. 869854 at SEQ ID NO. 342

SEQ ID NO: 695 - protein, 365 aa, Malus x domestica; identical to SEQ ID NO: 403
  misc_feature (1)..(365): Public GI ID no.114199048
  misc_feature (1)..(365): Bit score of 1053.4 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1053.4 for HMM based on sequences of FIGURE 17.
  misc_feature (1)..(365): Functional Homolog Of Ceres ANNOT ID no. 869854 at SEQ ID NO. 342

SEQ ID NO: 696 - protein, 365 aa, Malus x domestica; identical to SEQ ID NO: 406
  misc_feature (1)..(365): Public GI ID no.114199050
  misc_feature (1)..(365): Bit score of 1005.9 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1005.9 for HMM based on sequences of FIGURE 17.
  misc_feature (1)..(365): Functional Homolog Of Ceres ANNOT ID no. 869854 at SEQ ID NO. 342

SEQ ID NO: 697 - protein, 365 aa, Prunus dulcis; identical to SEQ ID NO: 407
  misc_feature (1)..(365): Public GI ID no.3913295
  misc_feature (1)..(365): Bit score of 1073.2 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1073.2 for HMM based on sequences of FIGURE 17.
  misc_feature (1)..(365): Functional Homolog Of Ceres ANNOT ID no. 869854 at SEQ ID NO. 342

SEQ ID NO: 698 - protein, 365 aa, Medicago sativa; identical to SEQ ID NO: 410
  misc_feature (1)..(365): Public GI ID no.116908
  misc_feature (1)..(365): Bit score of 1051.2 for HMM based on sequences of FIGURE 17.
  misc_feature (34)..(85): Pfam Name: Dimerisation Pfam Description: Dimerisation domain
  misc_feature (95)..(340): Pfam Name: Methyltransf_2 Pfam Description: O-methyltransferase
  misc_feature (95)..(340): Pfam Name: Methyltransf_2 Pfam Description: O-methyltransferase
  misc_feature (1)..(365): Bit score of 1051.2 for HMM based on sequences of FIGURE 17.
  misc_feature (1)..(365): Functional Homolog Of Ceres ANNOT ID no. 869854 at SEQ ID NO. 342

SEQ ID NO: 699 - protein, 365 aa, Medicago truncatula; identical to SEQ ID NO: 411
  misc_feature (1)..(365): Public GI ID no.92878636
  misc_feature (1)..(365): Bit score of 1053.8 for HMM based on sequences of FIGURE 17.
  misc_feature (34)..(85): Pfam Name: Dimerisation Pfam Description: Dimerisation domain
  misc_feature (95)..(340): Pfam Name: Methyltransf_2 Pfam Description: O-methyltransferase
  misc_feature (95)..(340): Pfam Name: Methyltransf_2 Pfam Description: O-methyltransferase
  misc_feature (1)..(365): Bit score of 1053.8 for HMM based on sequences of FIGURE 17.
  misc_feature (1)..(365): Functional Homolog Of Ceres ANNOT ID no. 869854 at SEQ ID NO. 342

SEQ ID NO: 700 - protein, 366 aa, Eucalyptus gunnii; identical to SEQ ID NO: 412
  misc_feature (1)..(366): Public GI ID no.1169009
  misc_feature (1)..(366): Bit score of 1045.6 for HMM based on sequences of FIGURE 17.
  misc_feature (35)..(86): Pfam Name: Dimerisation Pfam Description: Dimerisation domain
  misc_feature (95)..(341): Pfam Name: Methyltransf_2 Pfam Description: O-methyltransferase
  misc_feature (95)..(341): Pfam Name: Methyltransf_2 Pfam Description: O-methyltransferase
  misc_feature (1)..(366): Bit score of 1045.6 for HMM based on sequences of FIGURE 17.
  misc_feature (1)..(366): Functional Homolog Of Ceres ANNOT ID no. 869854 at SEQ ID NO. 342

SEQ ID NO: 701 - protein, 363 aa, Catharanthus roseus; identical to SEQ ID NO: 413
  misc_feature (1)..(363): Public GI ID no.29839377
  misc_feature (1)..(363): Bit score of 1047.0 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(363): Bit score of 1047 for HMM based on sequences of FIGURE 17.
  misc_feature (1)..(363): Functional Homolog Of Ceres ANNOT ID no. 869854 at SEQ ID NO. 342

SEQ ID NO: 702 - protein, 359 aa, Capsicum annuum; identical to SEQ ID NO: 414
  misc_feature (1)..(359): Public GI ID no.12003964
  misc_feature (1)..(359): Bit score of 1039.5 for HMM based on sequences of FIGURE 17.
  misc_feature (30)..(81): Pfam Name: Dimerisation Pfam Description: Dimerisation domain
  misc_feature (90)..(336): Pfam Name: Methyltransf_2 Pfam Description: O-methyltransferase
  misc_feature (90)..(336): Pfam Name: Methyltransf_2 Pfam Description: O-methyltransferase
  misc_feature (1)..(359): Bit score of 1039.5 for HMM based on sequences of FIGURE 17.
  misc_feature (1)..(359): Functional Homolog Of Ceres ANNOT ID no. 869854 at SEQ ID NO. 342

SEQ ID NO: 703 - protein, 359 aa, Capsicum annuum; identical to SEQ ID NO: 415
  misc_feature (1)..(359): Public GI ID no.30315948
  misc_feature (1)..(359): Bit score of 1031.8 for HMM based on sequences of FIGURE 17.
  misc_feature (30)..(81): Pfam Name: Dimerisation Pfam Description: Dimerisation domain
  misc_feature (90)..(336): Pfam Name: Methyltransf_2 Pfam Description: O-methyltransferase
  misc_feature (90)..(336): Pfam Name: Methyltransf_2 Pfam Description: O-methyltransferase
  misc_feature (1)..(359): Bit score of 1031.8 for HMM based on sequences of FIGURE 17.
  misc_feature (1)..(359): Functional Homolog Of Ceres ANNOT ID no. 869854 at SEQ ID NO. 342

SEQ ID NO: 704 - protein, 364 aa, Nicotiana tabacum; identical to SEQ ID NO: 416
  misc_feature (1)..(364): Public GI ID no.396589
  misc_feature (1)..(364): Bit score of 993.3 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(364): Bit score of 993.3 for HMM based on sequences of FIGURE 17.
  misc_feature (1)..(364): Functional Homolog Of Ceres ANNOT ID no. 869854 at SEQ ID NO. 342

SEQ ID NO: 705 - protein, 364 aa, Nicotiana tabacum; identical to SEQ ID NO: 417
  misc_feature (1)..(364): Public GI ID no.396591
  misc_feature (1)..(364): Bit score of 990.6 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(364): Bit score of 990.6 for HMM based on sequences of FIGURE 17.
  misc_feature (1)..(364): Functional Homolog Of Ceres ANNOT ID no. 869854 at SEQ ID NO. 342

SEQ ID NO: 706 - protein, 367 aa, Liquidambar styraciflua; identical to SEQ ID NO: 418
  misc_feature (1)..(367): Public GI ID no.5732000
  misc_feature (1)..(367): Bit score of 1041.7 for HMM based on sequences of FIGURE 17.
  misc_feature (36)..(87): Pfam Name: Dimerisation Pfam Description: Dimerisation domain
  misc_feature (96)..(342): Pfam Name: Methyltransf_2 Pfam Description: O-methyltransferase
  misc_feature (96)..(342): Pfam Name: Methyltransf_2 Pfam Description: O-methyltransferase
  misc_feature (1)..(367): Bit score of 1041.7 for HMM based on sequences of FIGURE 17.
  misc_feature (1)..(367): Functional Homolog Of Ceres ANNOT ID no. 869854 at SEQ ID NO. 342

SEQ ID NO: 707 - protein, 352 aa, Hordeum vulgare; identical to SEQ ID NO: 419
  misc_feature (1)..(352): Public GI ID no.27531337
  misc_feature (1)..(352): Bit score of 792.6 for HMM based on sequences of FIGURE 17.
  misc_feature (21)..(74): Pfam Name: Dimerisation Pfam Description: Dimerisation domain
  misc_feature (83)..(329): Pfam Name: Methyltransf_2 Pfam Description: O-methyltransferase
  misc_feature (1)..(352): Bit score of 792.6 for HMM based on sequences of FIGURE 17.
  misc_feature (1)..(352): Functional Homolog Of Ceres ANNOT ID no. 869854 at SEQ ID NO. 342

SEQ ID NO: 708 - protein, 360 aa, Lolium perenne; identical to SEQ ID NO: 420
  misc_feature (1)..(360): Public GI ID no.2388664
  misc_feature (1)..(360): Bit score of 933.7 for HMM based on sequences of FIGURE 17.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 933.7 for HMM based on sequences of FIGURE 17.
  misc_feature (1)..(360): Functional Homolog Of Ceres ANNOT ID no. 869854 at SEQ ID NO. 342

SEQ ID NO: 709 - protein, 361 aa, Lolium perenne; identical to SEQ ID NO: 422
  misc_feature (1)..(361): Public GI ID no.4104224
  misc_feature (1)..(361): Bit score of 914.6 for HMM based on sequences of FIGURE 17.
  misc_feature (31)..(83): Pfam Name: Dimerisation Pfam Description: Dimerisation domain
  misc_feature (92)..(338): Pfam Name: Methyltransf_2 Pfam Description: O-methyltransferase
  misc_feature (92)..(338): Pfam Name: Methyltransf_2 Pfam Description: O-methyltransferase
  misc_feature (1)..(361): Bit score of 914.6 for HMM based on sequences of FIGURE 17.
  misc_feature (1)..(361): Functional Homolog Of Ceres ANNOT ID no. 869854 at SEQ ID NO. 342

SEQ ID NO: 710 - protein, 360 aa, Lolium perenne; identical to SEQ ID NO: 421
  misc_feature (1)..(360): Public GI ID no.4104220
  misc_feature (1)..(360): Bit score of 933.4 for HMM based on sequences of FIGURE 17.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 933.4 for HMM based on sequences of FIGURE 17.
  misc_feature (1)..(360): Functional Homolog Of Ceres ANNOT ID no. 869854 at SEQ ID NO. 342

SEQ ID NO: 711 - protein, 362 aa, Saccharum officinarum; identical to SEQ ID NO: 423
  misc_feature (1)..(362): Public GI ID no.29839259
  misc_feature (1)..(362): Bit score of 935.2 for HMM based on sequences of FIGURE 17.
  misc_feature (31)..(85): Pfam Name: Dimerisation Pfam Description: Dimerisation domain
  misc_feature (94)..(339): Pfam Name: Methyltransf_2 Pfam Description: O-methyltransferase
  misc_feature (94)..(339): Pfam Name: Methyltransf_2 Pfam Description: O-methyltransferase
  misc_feature (1)..(362): Bit score of 935.2 for HMM based on sequences of FIGURE 17.
  misc_feature (1)..(362): Functional Homolog Of Ceres ANNOT ID no. 869854 at SEQ ID NO. 342

SEQ ID NO: 712 - protein, 362 aa, Sorghum bicolor; identical to SEQ ID NO: 425
  misc_feature (1)..(362): Public GI ID no.18033964
  misc_feature (1)..(362): Bit score of 910.2 for HMM based on sequences of FIGURE 17.
  misc_feature (31)..(83): Pfam Name: Dimerisation Pfam Description: Dimerisation domain
  misc_feature (92)..(339): Pfam Name: Methyltransf_2 Pfam Description: O-methyltransferase
  misc_feature (92)..(339): Pfam Name: Methyltransf_2 Pfam Description: O-methyltransferase
  misc_feature (1)..(362): Bit score of 910.2 for HMM based on sequences of FIGURE 17.
  misc_feature (1)..(362): Functional Homolog Of Ceres ANNOT ID no. 869854 at SEQ ID NO. 342

SEQ ID NO: 713 - protein, 362 aa, Sorghum bicolor; identical to SEQ ID NO: 424
  misc_feature (1)..(362): Public GI ID no.28569609
  misc_feature (1)..(362): Bit score of 912.9 for HMM based on sequences of FIGURE 17.
  misc_feature (31)..(83): Pfam Name: Dimerisation Pfam Description: Dimerisation domain
  misc_feature (92)..(339): Pfam Name: Methyltransf_2 Pfam Description: O-methyltransferase
  misc_feature (92)..(339): Pfam Name: Methyltransf_2 Pfam Description: O-methyltransferase
  misc_feature (1)..(362): Bit score of 912.9 for HMM based on sequences of FIGURE 17.
  misc_feature (1)..(362): Functional Homolog Of Ceres ANNOT ID no. 869854 at SEQ ID NO. 342

SEQ ID NO: 714 - protein, 356 aa, Triticum aestivum; identical to SEQ ID NO: 427
  misc_feature (1)..(356): Public GI ID no.77818928
  misc_feature (1)..(356): Bit score of 938.3 for HMM based on sequences of FIGURE 17.
  misc_feature (27)..(78): Pfam Name: Dimerisation Pfam Description: Dimerisation domain
  misc_feature (87)..(333): Pfam Name: Methyltransf_2 Pfam Description: O-methyltransferase
  misc_feature (87)..(333): Pfam Name: Methyltransf_2 Pfam Description: O-methyltransferase
  misc_feature (1)..(356): Bit score of 938.3 for HMM based on sequences of FIGURE 17.
  misc_feature (1)..(356): Functional Homolog Of Ceres ANNOT ID no. 869854 at SEQ ID NO. 342

SEQ ID NO: 715 - DNA, 1413 bp, Triticum aestivum; identical to SEQ ID NO: 618
  misc_feature (1)..(1413): Ceres CLONE ID no.570057
  misc_feature (1)..(1413): Encodes the peptide sequence at SEQ ID NO 716

SEQ ID NO: 716 - protein, 360 aa, Triticum aestivum; identical to SEQ ID NO: 619
  misc_feature (1)..(360): Ceres CLONE ID no.570057
  misc_feature (1)..(360): Bit score of 936.8 for HMM based on sequences of FIGURE 17.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 936.8 for HMM based on sequences of FIGURE 17.
  misc_feature (1)..(360): Functional Homolog Of Ceres ANNOT ID no. 869854 at SEQ ID NO. 342

SEQ ID NO: 717 - protein, 360 aa, Triticum aestivum; identical to SEQ ID NO: 426
  misc_feature (1)..(360): Public GI ID no.30385246
  misc_feature (1)..(360): Bit score of 926.0 for HMM based on sequences of FIGURE 17.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 926 for HMM based on sequences of FIGURE 17.
  misc_feature (1)..(360): Functional Homolog Of Ceres ANNOT ID no. 869854 at SEQ ID NO. 342

SEQ ID NO: 718 - DNA, 1277 bp, Zea mays
  misc_feature (1)..(1277): Ceres CLONE ID no.1453701
  misc_feature (1)..(1277): Encodes the peptide sequence at SEQ ID NO 719
tccaaagtaggtcatcgctcagtcgctcgctcacactcaacgccacgtagcagcagctcggctccggcggggcagaagcaagcagagatggggtcgatcgccgccggcgccgacgaggatgcgtgcatgtacgctctccagctcgtctcgtcgtcgatcctcccgatgacgctgaagaacgccatcgagctggggctcctcgagaccctgatggccgccggcggcaagttcttgactcccgctgaggtggcagccaagctcccgtccgcggcgaatccggaagcgccggacatggtggaccgtatgctccgtctgttggcctcgtacaacgtggtgtcgtgcaggacggaggagggcaaggacggccgcctctcccggcggtacggcgccgcgcccgtgtgcaagtacctcacccccaacgaggacggcgtgtccatgtcggcgctcgcgctcatgaaccaggacaaggtcctcatggagagctggtactatctcaaggatgcggtcctcgacggtggcatcccgttcaacaaggcgtacgggatgtcggcgttcgagtaccacggcacggacccacgcttcaaccgcgtcttcaacgaggggatgaagaaccattccatcatcatcaccaagaagctcctcgagtcctacaagggcttcgagggcctcggcaccctcgtcgacgtgggcggtggcgtcggcgccaccgtggccgccatcaccgctcactaccccaccatcaagggcatcaactttgaccttccccacgtcatcagtgaggcgccgccgttccccggtgtcacccacgtcggcggcgacatgttccagaaggtgccctcgggcgacgccatcctcatgaagtggatcctccacgactggagcgacgagcactgcgcgacgctgctcaagaactgctacgacgcgttgccggcgcacggcaaggtggtgctcgtggagtgcatcctgccggtgaacccggaggcgacgcctaaggcgcagggggtgttccatgtcgacatgatcatgctcgcgcacaacccgggtggcagggagaggtacgagagggagttcgaggccctggccaagggcgccgggttcgccgccatgaagactacttacatctacgccaacgcatgggccatcgagttcactaagtagatgatccatgacaacgagtctacctctctgatgcatccacctgcatgtgtactttctcttcgtttttccttcaaaaaaaatttcactctctgagtcaatctataaaaaaaaaaaaaaaa

SEQ ID NO: 719 - protein, 356 aa, Zea mays
  misc_feature (1)..(356): Ceres CLONE ID no.1453701
  misc_feature (1)..(356): Bit score of 938.3 for HMM based on sequences of FIGURE 17.
  misc_feature (27)..(78): Pfam Name: Dimerisation Pfam Description: Dimerisation domain
  misc_feature (87)..(333): Pfam Name: Methyltransf_2 Pfam Description: O-methyltransferase
  misc_feature (87)..(333): Pfam Name: Methyltransf_2 Pfam Description: O-methyltransferase
  misc_feature (1)..(356): Bit score of 938.3 for HMM based on sequences of FIGURE 17.
  misc_feature (1)..(356): Functional Homolog Of Ceres ANNOT ID no. 869854 at SEQ ID NO. 342
MGSIAAGADEDACMYALQLVSSSILPMTLKNAIELGLLETLMAAGGKFLTPAEVAAKLPSAANPEAPDMVDRMLRLLASYNVVSCRTEEGKDGRLSRRYGAAPVCKYLTPNEDGVSMSALALMNQDKVLMESWYYLKDAVLDGGIPFNKAYGMSAFEYHGTDPRFNRVFNEGMKNHSIIITKKLLESYKGFEGLGTLVDVGGGVGATVAAITAHYPTIKGINFDLPHVISEAPPFPGVTHVGGDMFQKVPSGDAILMKWILHDWSDEHCATLLKNCYDALPAHGKVVLVECILPVNPEATPKAQGVFHVDMIMLAHNPGGRERYEREFEALAKGAGFAAMKTTYIYANAWAIEFTK

SEQ ID NO: 720 - protein, 360 aa, Festuca arundinacea; identical to SEQ ID NO: 445
  misc_feature (1)..(360): Public GI ID no.14578615
  misc_feature (1)..(360): Bit score of 941.7 for HMM based on sequences of FIGURE 17.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 941.7 for HMM based on sequences of FIGURE 17.
  misc_feature (1)..(360): Functional Homolog Of Ceres ANNOT ID no. 869854 at SEQ ID NO. 342

SEQ ID NO: 721 - protein, 360 aa, Festuca arundinacea; identical to SEQ ID NO: 443
  misc_feature (1)..(360): Public GI ID no.14578613
  misc_feature (1)..(360): Bit score of 938.2 for HMM based on sequences of FIGURE 17.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 938.2 for HMM based on sequences of FIGURE 17.
  misc_feature (1)..(360): Functional Homolog Of Ceres ANNOT ID no. 869854 at SEQ ID NO. 342

SEQ ID NO: 722 - protein, 360 aa, Festuca arundinacea; identical to SEQ ID NO: 444
  misc_feature (1)..(360): Public GI ID no.14578611
  misc_feature (1)..(360): Bit score of 941.4 for HMM based on sequences of FIGURE 17.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 941.4 for HMM based on sequences of FIGURE 17.
  misc_feature (1)..(360): Functional Homolog Of Ceres ANNOT ID no. 869854 at SEQ ID NO. 342

SEQ ID NO: 723 - protein, 360 aa, Festuca arundinacea; identical to SEQ ID NO: 446
  misc_feature (1)..(360): Public GI ID no.14578617
  misc_feature (1)..(360): Bit score of 914.1 for HMM based on sequences of FIGURE 17.
  misc_feature (31)..(82): Pfam Name: Dimerisation Pfam Description: Dimerisation domain
  misc_feature (91)..(337): Pfam Name: Methyltransf_2 Pfam Description: O-methyltransferase
  misc_feature (91)..(337): Pfam Name: Methyltransf_2 Pfam Description: O-methyltransferase
  misc_feature (1)..(360): Bit score of 914.1 for HMM based on sequences of FIGURE 17.
  misc_feature (1)..(360): Functional Homolog Of Ceres ANNOT ID no. 869854 at SEQ ID NO. 342

SEQ ID NO: 724 - protein, 386 aa, Vitis vinifera; identical to SEQ ID NO: 449
  misc_feature (1)..(386): Public GI ID no.7271883
  misc_feature (1)..(386): Bit score of 956.7 for HMM based on sequences of FIGURE 17.
  misc_feature (114)..(361): Pfam Name: Methyltransf_2 Pfam Description: O-methyltransferase
  misc_feature (114)..(361): Pfam Name: Methyltransf_2 Pfam Description: O-methyltransferase
  misc_feature (54)..(105): Pfam Name: Dimerisation Pfam Description: Dimerisation domain
  misc_feature (1)..(386): Bit score of 956.7 for HMM based on sequences of FIGURE 17.
  misc_feature (1)..(386): Functional Homolog Of Ceres ANNOT ID no. 869854 at SEQ ID NO. 342

SEQ ID NO: 725 - protein, 354 aa, Zinnia elegans; identical to SEQ ID NO: 450
  misc_feature (1)..(354): Public GI ID no.29839290
  misc_feature (1)..(354): Bit score of 959.3 for HMM based on sequences of FIGURE 17.
  misc_feature (24)..(76): Pfam Name: Dimerisation Pfam Description: Dimerisation domain
  misc_feature (84)..(331): Pfam Name: Methyltransf_2 Pfam Description: O-methyltransferase
  misc_feature (84)..(331): Pfam Name: Methyltransf_2 Pfam Description: O-methyltransferase
  misc_feature (1)..(354): Bit score of 959.3 for HMM based on sequences of FIGURE 17.
  misc_feature (1)..(354): Functional Homolog Of Ceres ANNOT ID no. 869854 at SEQ ID NO. 342

SEQ ID NO: 726 - protein, 364 aa, Mentha x piperita; identical to SEQ ID NO: 451
  misc_feature (1)..(364): Public GI ID no.38047397
  misc_feature (1)..(364): Bit score of 837.0 for HMM based on sequences of FIGURE 17.
  misc_feature (37)..(88): Pfam Name: Dimerisation Pfam Description: Dimerisation domain
  misc_feature (99)..(341): Pfam Name: Methyltransf_2 Pfam Description: O-methyltransferase
  misc_feature (1)..(364): Bit score of 837 for HMM based on sequences of FIGURE 17.
  misc_feature (1)..(364): Functional Homolog Of Ceres ANNOT ID no. 869854 at SEQ ID NO. 342

SEQ ID NO: 727 - protein, 365 aa, Populus sieboldii x Populus grandidentata; identical to SEQ ID NO: 452
  misc_feature (1)..(365): Public GI ID no.29839288
  misc_feature (1)..(365): Bit score of 1071.6 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1071.6 for HMM based on sequences of FIGURE 17.
  misc_feature (1)..(365): Functional Homolog Of Ceres ANNOT ID no. 869854 at SEQ ID NO. 342

SEQ ID NO: 728 - protein, 364 aa, Populus sieboldii x Populus grandidentata; identical to SEQ ID NO: 453
  misc_feature (1)..(364): Public GI ID no.29839289
  misc_feature (1)..(364): Bit score of 1003.6 for HMM based on sequences of FIGURE 17.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(364): Bit score of 1003.6 for HMM based on sequences of FIGURE 17.
  misc_feature (1)..(364): Functional Homolog Of Ceres ANNOT ID no. 869854 at SEQ ID NO. 342

SEQ ID NO: 729 - protein, 365 aa, Stylosanthes humilis; identical to SEQ ID NO: 454
  misc_feature (1)..(365): Public GI ID no.1582580
  misc_feature (1)..(365): Bit score of 1042.5 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1042.5 for HMM based on sequences of FIGURE 17.
  misc_feature (1)..(365): Functional Homolog Of Ceres ANNOT ID no. 869854 at SEQ ID NO. 342

SEQ ID NO: 730 - protein, 365 aa, Iris hollandica; identical to SEQ ID NO: 455
  misc_feature (1)..(365): Public GI ID no.57157826
  misc_feature (1)..(365): Bit score of 945.2 for HMM based on sequences of FIGURE 17.
  misc_feature (35)..(86): Pfam Name: Dimerisation Pfam Description: Dimerisation domain
  misc_feature (96)..(342): Pfam Name: Methyltransf_2 Pfam Description: O-methyltransferase
  misc_feature (96)..(342): Pfam Name: Methyltransf_2 Pfam Description: O-methyltransferase
  misc_feature (1)..(365): Bit score of 945.2 for HMM based on sequences of FIGURE 17.
  misc_feature (1)..(365): Functional Homolog Of Ceres ANNOT ID no. 869854 at SEQ ID NO. 342

SEQ ID NO: 731 - protein, 364 aa, Ipomoea nil; identical to SEQ ID NO: 457
  misc_feature (1)..(364): Public GI ID no.97974184
  misc_feature (1)..(364): Bit score of 1034.6 for HMM based on sequences of FIGURE 17.
  misc_feature (35)..(86): Pfam Name: Dimerisation Pfam Description: Dimerisation domain
  misc_feature (95)..(341): Pfam Name: Methyltransf_2 Pfam Description: O-methyltransferase
  misc_feature (95)..(341): Pfam Name: Methyltransf_2 Pfam Description: O-methyltransferase
  misc_feature (1)..(364): Bit score of 1034.6 for HMM based on sequences of FIGURE 17.
  misc_feature (1)..(364): Functional Homolog Of Ceres ANNOT ID no. 869854 at SEQ ID NO. 342

SEQ ID NO: 732 - protein, 364 aa, Ipomoea nil; identical to SEQ ID NO: 456
  misc_feature (1)..(364): Public GI ID no.97974173
  misc_feature (1)..(364): Bit score of 1028.5 for HMM based on sequences of FIGURE 17.
  misc_feature (35)..(86): Pfam Name: Dimerisation Pfam Description: Dimerisation domain
  misc_feature (95)..(341): Pfam Name: Methyltransf_2 Pfam Description: O-methyltransferase
  misc_feature (95)..(341): Pfam Name: Methyltransf_2 Pfam Description: O-methyltransferase
  misc_feature (1)..(364): Bit score of 1028.5 for HMM based on sequences of FIGURE 17.
  misc_feature (1)..(364): Functional Homolog Of Ceres ANNOT ID no. 869854 at SEQ ID NO. 342

SEQ ID NO: 733 - protein, 343 aa, Chrysosplenium americanum; identical to SEQ ID NO: 460
  misc_feature (1)..(343): Public GI ID no.567077
  misc_feature (1)..(343): Bit score of 862.2 for HMM based on sequences of FIGURE 17.
  misc_feature (15)..(64): Pfam Name: Dimerisation Pfam Description: Dimerisation domain
  misc_feature (75)..(316): Pfam Name: Methyltransf_2 Pfam Description: O-methyltransferase
  misc_feature (1)..(343): Bit score of 862.2 for HMM based on sequences of FIGURE 17.
  misc_feature (1)..(343): Functional Homolog Of Ceres ANNOT ID no. 869854 at SEQ ID NO. 342

SEQ ID NO: 734 - protein, 343 aa, Chrysosplenium americanum; identical to SEQ ID NO: 458
  misc_feature (1)..(343): Public GI ID no.24212064
  misc_feature (1)..(343): Bit score of 939.5 for HMM based on sequences of FIGURE 17.
  misc_feature (15)..(64): Pfam Name: Dimerisation Pfam Description: Dimerisation domain
  misc_feature (75)..(316): Pfam Name: Methyltransf_2 Pfam Description: O-methyltransferase
  misc_feature (75)..(316): Pfam Name: Methyltransf_2 Pfam Description: O-methyltransferase
  misc_feature (1)..(343): Bit score of 939.5 for HMM based on sequences of FIGURE 17.
  misc_feature (1)..(343): Functional Homolog Of Ceres ANNOT ID no. 869854 at SEQ ID NO. 342

SEQ ID NO: 735 - protein, 343 aa, Chrysosplenium americanum; identical to SEQ ID NO: 459
  misc_feature (1)..(343): Public GI ID no.24212067
  misc_feature (1)..(343): Bit score of 937.7 for HMM based on sequences of FIGURE 17.
  misc_feature (15)..(64): Pfam Name: Dimerisation Pfam Description: Dimerisation domain
  misc_feature (75)..(316): Pfam Name: Methyltransf_2 Pfam Description: O-methyltransferase
  misc_feature (75)..(316): Pfam Name: Methyltransf_2 Pfam Description: O-methyltransferase
  misc_feature (1)..(343): Bit score of 937.7 for HMM based on sequences of FIGURE 17.
  misc_feature (1)..(343): Functional Homolog Of Ceres ANNOT ID no. 869854 at SEQ ID NO. 342

SEQ ID NO: 736 - protein, 370 aa, Clarkia breweri; identical to SEQ ID NO: 462
  misc_feature (1)..(370): Public GI ID no.3913289
  misc_feature (1)..(370): Bit score of 1030.5 for HMM based on sequences of FIGURE 17.
  misc_feature (36)..(90): Pfam Name: Dimerisation Pfam Description: Dimerisation domain
  misc_feature (99)..(345): Pfam Name: Methyltransf_2 Pfam Description: O-methyltransferase
  misc_feature (99)..(345): Pfam Name: Methyltransf_2 Pfam Description: O-methyltransferase
  misc_feature (1)..(370): Bit score of 1030.5 for HMM based on sequences of FIGURE 17.
  misc_feature (1)..(370): Functional Homolog Of Ceres ANNOT ID no. 869854 at SEQ ID NO. 342

SEQ ID NO: 737 - protein, 368 aa, Clarkia breweri; identical to SEQ ID NO: 463
  misc_feature (1)..(368): Public GI ID no.38502831
  misc_feature (1)..(368): Bit score of 909.4 for HMM based on sequences of FIGURE 17.
  misc_feature (36)..(88): Pfam Name: Dimerisation Pfam Description: Dimerisation domain
  misc_feature (97)..(343): Pfam Name: Methyltransf_2 Pfam Description: O-methyltransferase
  misc_feature (97)..(343): Pfam Name: Methyltransf_2 Pfam Description: O-methyltransferase
  misc_feature (1)..(368): Bit score of 909.4 for HMM based on sequences of FIGURE 17.
  misc_feature (1)..(368): Functional Homolog Of Ceres ANNOT ID no. 869854 at SEQ ID NO. 342

SEQ ID NO: 738 - DNA, 1448 bp, Panicum virgatum; identical to SEQ ID NO: 639
  misc_feature (1)..(1448): Ceres CLONE ID no.1869486
  misc_feature (1)..(1448): Encodes the peptide sequence at SEQ ID NO 739

SEQ ID NO: 739 - protein, 361 aa, Panicum virgatum; identical to SEQ ID NO: 640
  misc_feature (1)..(361): Ceres CLONE ID no.1869486
  misc_feature (1)..(361): Bit score of 936.0 for HMM based on sequences of FIGURE 17.
  misc_feature (31)..(83): Pfam Name: Dimerisation Pfam Description: Dimerisation domain
  misc_feature (92)..(338): Pfam Name: Methyltransf_2 Pfam Description: O-methyltransferase
  misc_feature (92)..(338): Pfam Name: Methyltransf_2 Pfam Description: O-methyltransferase
  misc_feature (1)..(361): Bit score of 936 for HMM based on sequences of FIGURE 17.
  misc_feature (1)..(361): Functional Homolog Of Ceres ANNOT ID no. 869854 at SEQ ID NO. 342

SEQ ID NO: 740 - DNA, 1569 bp, Panicum virgatum
  misc_feature (1)..(1569): Ceres CLONE ID no.1770156
  misc_feature (1)..(1569): Encodes the peptide sequence at SEQ ID NO 741
gcacccaagcaacacatcagagcacaaagactagggcaagaaagatacagagtgagtgagcaagagagaccagagaatggccgctgattctcggaccatcatagctcccactgatgctgagctgctgcaggcacaagccgacctatggcgccacagcctctactacctcacatccatggcgctcaagtgcgccgtcgagcttcacattccaactgctatccataaactcggaggggctgcctcgctgccagacttggtaaccgcactgtcccttcctcagactaagcttccattcctgcgccgcttgatgcggctgctcgtcacatcaggcatctttgcatctgaaagtggtgctgaggtggagacgtaccgcctcaatccactctcctggctccttgtagaaggtgtggaagcagaaaaccacacctaccagaaatactttgtgctcgccacagtctcgaggcattatcttgaggctgcatcgtctctagctgactggttcaagaaggatttgcctgtgccaacaccatcgccattcgaggaacagcatggtgtgccacttgtccatgagaaaacaaagctccttgacgaagagctagacaggattgtcaatgaaggtgtggctgcacatgacaacttggcaattggaaccattattcgggagtgcggtgacattttcaggggtgttcaatcactgactgattgcggtggtggtgatggcaccactgtgaggggaatcatcaaggcgttccctcacatcaagtgtactgtgctggaccttccaaaggttattgagaatgcaccacctcatgattctgttacctatgtcgcgggtgacatgttccactccatcccacctgctcaagctgtgatgataaagcttctactgcacttctttagcgatgaggattgtgtaaagatcctggagcagtgcaagaaggcaattccttcaaaagaagagggagggaaagtgattattatagaaatagtcgttgacccttctctagggccaataatgtatgaagcccaactcctgatggacttgctcatgatggtgaatatcagaggcaggcagcgagatgaaaatgattggcgtgagatctttatgaaagccggcttctcagactataagattgttaagaaaataggagctcgtggtgtcatcgaagtttacccgtaaattatgcccaatgtgtggttcagtatttaatggtccatgagctgcagtgaggatataaataaacgtagtgcctcatttcctatatgctgtggggacataaataaacggagcgcctcatttccaagataaagtttgatgggatctgaaagcagatgagctgaccagctttctggcctttagatccacatgtagctgctgtttgcaatgtactagagcactctttgtggttggtttccagcagtcaagtatgtatgttggtttgactttgatcatatatatattggattgttgtttgttgatatgtatgttatgtacaaccacgacaagttatgcaatgtgtaatttatcattatatatatcactacatagcaaaaaaaaaaaaaaaaaaa

SEQ ID NO: 741 - protein, 367 aa, Panicum virgatum
  misc_feature (1)..(367): Ceres CLONE ID no.1770156
  misc_feature (1)..(367): Bit score of 89.2 for HMM based on sequences of FIGURE 17.
  misc_feature (34)..(82): Pfam Name: Dimerisation Pfam Description: Dimerisation domain
  misc_feature (88)..(344): Pfam Name: Methyltransf_2 Pfam Description: O-methyltransferase
  misc_feature (1)..(367): Bit score of 89.2 for HMM based on sequences of FIGURE 17.
  misc_feature (1)..(367): Functional Homolog Of Ceres ANNOT ID no. 869854 at SEQ ID NO. 342
MAADSRTIIAPTDAELLQAQADLWRHSLYYLTSMALKCAVELHIPTAIHKLGGAASLPDLVTALSLPQTKLPFLRRLMRLLVTSGIFASESGAEVETYRLNPLSWLLVEGVEAENHTYQKYFVLATVSRHYLEAASSLADWFKKDLPVPTPSPFEEQHGVPLVHEKTKLLDEELDRIVNEGVAAHDNLAIGTIIRECGDIFRGVQSLTDCGGGDGTTVRGIIKAFPHIKCTVLDLPKVIENAPPHDSVTYVAGDMFHSIPPAQAVMIKLLLHFFSDEDCVKILEQCKKAIPSKEEGGKVIIIEIVVDPSLGPIMYEAQLLMDLLMMVNIRGRQRDENDWREIFMKAGFSDYKIVKKIGARGVIEVYP

SEQ ID NO: 742 - protein, 361 aa, Ocimum basilicum; identical to SEQ ID NO: 466
  misc_feature (1)..(361): Public GI ID no.29839421
  misc_feature (1)..(361): Bit score of 1037.0 for HMM based on sequences of FIGURE 17.
  misc_feature (32)..(83): Pfam Name: Dimerisation Pfam Description: Dimerisation domain
  misc_feature (92)..(338): Pfam Name: Methyltransf_2 Pfam Description: O-methyltransferase
  misc_feature (92)..(338): Pfam Name: Methyltransf_2 Pfam Description: O-methyltransferase
  misc_feature (1)..(361): Bit score of 1037 for HMM based on sequences of FIGURE 17.
  misc_feature (1)..(361): Functional Homolog Of Ceres ANNOT ID no. 869854 at SEQ ID NO. 342

SEQ ID NO: 743 - protein, 361 aa, Ocimum basilicum; identical to SEQ ID NO: 467
  misc_feature (1)..(361): Public GI ID no.29839420
  misc_feature (1)..(361): Bit score of 1022.0 for HMM based on sequences of FIGURE 17.
  misc_feature (32)..(83): Pfam Name: Dimerisation Pfam Description: Dimerisation domain
  misc_feature (92)..(338): Pfam Name: Methyltransf_2 Pfam Description: O-methyltransferase
  misc_feature (92)..(338): Pfam Name: Methyltransf_2 Pfam Description: O-methyltransferase
  misc_feature (1)..(361): Bit score of 1022 for HMM based on sequences of FIGURE 17.
  misc_feature (1)..(361): Functional Homolog Of Ceres ANNOT ID no. 869854 at SEQ ID NO. 342

SEQ ID NO: 744 - protein, 361 aa, Oryza sativa subsp. indica; identical to SEQ ID NO: 468
  misc_feature (1)..(361): Public GI ID no.125560205
  misc_feature (1)..(361): Bit score of 906.9 for HMM based on sequences of FIGURE 17.
  misc_feature (24)..(82): Pfam Name: Dimerisation Pfam Description: Dimerisation domain
  misc_feature (91)..(338): Pfam Name: Methyltransf_2 Pfam Description: O-methyltransferase
  misc_feature (91)..(338): Pfam Name: Methyltransf_2 Pfam Description: O-methyltransferase
  misc_feature (1)..(361): Bit score of 906.9 for HMM based on sequences of FIGURE 17.
  misc_feature (1)..(361): Functional Homolog Of Ceres ANNOT ID no. 869854 at SEQ ID NO. 342

SEQ ID NO: 745 - protein, 368 aa, Oryza sativa subsp. japonica; identical to SEQ ID NO: 469
  misc_feature (1)..(368): Public GI ID no.115474869
  misc_feature (1)..(368): Bit score of 919.5 for HMM based on sequences of FIGURE 17.
  misc_feature (31)..(89): Pfam Name: Dimerisation Pfam Description: Dimerisation domain
  misc_feature (98)..(345): Pfam Name: Methyltransf_2 Pfam Description: O-methyltransferase
  misc_feature (98)..(345): Pfam Name: Methyltransf_2 Pfam Description: O-methyltransferase
  misc_feature (1)..(368): Bit score of 919.5 for HMM based on sequences of FIGURE 17.
  misc_feature (1)..(368): Functional Homolog Of Ceres ANNOT ID no. 869854 at SEQ ID NO. 342

SEQ ID NO: 746 - protein, 361 aa, Oryza sativa subsp. japonica; identical to SEQ ID NO: 470
  misc_feature (1)..(361): Public GI ID no.125602246
  misc_feature (1)..(361): Bit score of 905.4 for HMM based on sequences of FIGURE 17.
  misc_feature (24)..(82): Pfam Name: Dimerisation Pfam Description: Dimerisation domain
  misc_feature (91)..(338): Pfam Name: Methyltransf_2 Pfam Description: O-methyltransferase
  misc_feature (91)..(338): Pfam Name: Methyltransf_2 Pfam Description: O-methyltransferase
  misc_feature (1)..(361): Bit score of 905.4 for HMM based on sequences of FIGURE 17.
  misc_feature (1)..(361): Functional Homolog Of Ceres ANNOT ID no. 869854 at SEQ ID NO. 342

SEQ ID NO: 747 - protein, 367 aa, Glycyrrhiza echinata; identical to SEQ ID NO: 471
  misc_feature (1)..(367): Public GI ID no.1669591
  misc_feature (1)..(367): Bit score of 517.0 for HMM based on sequences of FIGURE 17.
  misc_feature (102)..(343): Pfam Name: Methyltransf_2 Pfam Description: O-methyltransferase
  misc_feature (39)..(93): Pfam Name: Dimerisation Pfam Description: Dimerisation domain
  misc_feature (1)..(367): Bit score of 517 for HMM based on sequences of FIGURE 17.
  misc_feature (1)..(367): Functional Homolog Of Ceres ANNOT ID no. 869854 at SEQ ID NO. 342

SEQ ID NO: 748 - protein, 365 aa, Ammi majus; identical to SEQ ID NO: 472
  misc_feature (1)..(365): Public GI ID no.38565551
  misc_feature (1)..(365): Bit score of 1002.0 for HMM based on sequences of FIGURE 17.
  misc_feature (36)..(87): Pfam Name: Dimerisation Pfam Description: Dimerisation domain
  misc_feature (96)..(342): Pfam Name: Methyltransf_2 Pfam Description: O-methyltransferase
  misc_feature (96)..(342): Pfam Name: Methyltransf_2 Pfam Description: O-methyltransferase
  misc_feature (1)..(365): Bit score of 1002 for HMM based on sequences of FIGURE 17.
  misc_feature (1)..(365): Functional Homolog Of Ceres ANNOT ID no. 869854 at SEQ ID NO. 342

SEQ ID NO: 749 - protein, 350 aa, Coffea canephora; identical to SEQ ID NO: 473
  misc_feature (1)..(350): Public GI ID no.22652500
  misc_feature (1)..(350): Bit score of 1018.3 for HMM based on sequences of FIGURE 17.
  misc_feature (21)..(72): Pfam Name: Dimerisation Pfam Description: Dimerisation domain
  misc_feature (81)..(327): Pfam Name: Methyltransf_2 Pfam Description: O-methyltransferase
  misc_feature (81)..(327): Pfam Name: Methyltransf_2 Pfam Description: O-methyltransferase
  misc_feature (1)..(350): Bit score of 1018.3 for HMM based on sequences of FIGURE 17.
  misc_feature (1)..(350): Functional Homolog Of Ceres ANNOT ID no. 869854 at SEQ ID NO. 342

SEQ ID NO: 750 - protein, 350 aa, Coffea canephora; identical to SEQ ID NO: 474
  misc_feature (1)..(350): Public GI ID no.29839361
  misc_feature (1)..(350): Bit score of 1017.2 for HMM based on sequences of FIGURE 17.
  misc_feature (21)..(72): Pfam Name: Dimerisation Pfam Description: Dimerisation domain
  misc_feature (81)..(327): Pfam Name: Methyltransf_2 Pfam Description: O-methyltransferase
  misc_feature (81)..(327): Pfam Name: Methyltransf_2 Pfam Description: O-methyltransferase
  misc_feature (1)..(350): Bit score of 1017.2 for HMM based on sequences of FIGURE 17.
  misc_feature (1)..(350): Functional Homolog Of Ceres ANNOT ID no. 869854 at SEQ ID NO. 342

SEQ ID NO: 751 - protein, 359 aa, Vanilla planifolia; identical to SEQ ID NO: 648
  misc_feature (1)..(359): Public GI ID no.89113191
  misc_feature (1)..(359): Bit score of 807.4 for HMM based on sequences of FIGURE 17.
  misc_feature (28)..(79): Pfam Name: Dimerisation Pfam Description: Dimerisation domain
  misc_feature (88)..(336): Pfam Name: Methyltransf_2 Pfam Description: O-methyltransferase
  misc_feature (1)..(359): Bit score of 807.4 for HMM based on sequences of FIGURE 17.
  misc_feature (1)..(359): Functional Homolog Of Ceres ANNOT ID no. 869854 at SEQ ID NO. 342

SEQ ID NO: 752 - protein, 359 aa, Vanilla planifolia; identical to SEQ ID NO: 649
  misc_feature (1)..(359): Public GI ID no.89113193
  misc_feature (1)..(359): Bit score of 789.4 for HMM based on sequences of FIGURE 17.
  misc_feature (28)..(79): Pfam Name: Dimerisation Pfam Description: Dimerisation domain
  misc_feature (92)..(336): Pfam Name: Methyltransf_2 Pfam Description: O-methyltransferase
  misc_feature (1)..(359): Bit score of 789.4 for HMM based on sequences of FIGURE 17.
  misc_feature (1)..(359): Functional Homolog Of Ceres ANNOT ID no. 869854 at SEQ ID NO. 342

SEQ ID NO: 753 - protein, 365 aa, Acacia mangium x Acacia auriculiformis; identical to SEQ ID NO: 476
  misc_feature (1)..(365): Public GI ID no.68159362
  misc_feature (1)..(365): Bit score of 1033.8 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1033.8 for HMM based on sequences of FIGURE 17.
  misc_feature (1)..(365): Functional Homolog Of Ceres ANNOT ID no. 869854 at SEQ ID NO. 342

SEQ ID NO: 754 - protein, 365 aa, Rosa chinensis; identical to SEQ ID NO: 477
  misc_feature (1)..(365): Public GI ID no.29839344
  misc_feature (1)..(365): Bit score of 1062.5 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1062.5 for HMM based on sequences of FIGURE 17.
  misc_feature (1)..(365): Functional Homolog Of Ceres ANNOT ID no. 869854 at SEQ ID NO. 342

SEQ ID NO: 755 - protein, 362 aa, Thalictrum tuberosum; identical to SEQ ID NO: 479
  misc_feature (1)..(362): Public GI ID no.4808524
  misc_feature (1)..(362): Bit score of 1000.4 for HMM based on sequences of FIGURE 17.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(362): Bit score of 1000.4 for HMM based on sequences of FIGURE 17.
  misc_feature (1)..(362): Functional Homolog Of Ceres ANNOT ID no. 869854 at SEQ ID NO. 342

SEQ ID NO: 756 - protein, 364 aa, Thalictrum tuberosum; identical to SEQ ID NO: 481
  misc_feature (1)..(364): Public GI ID no.4808528
  misc_feature (1)..(364): Bit score of 997.5 for HMM based on sequences of FIGURE 17.
  misc_feature (35)..(86): Pfam Name: Dimerisation Pfam Description: Dimerisation domain
  misc_feature (95)..(341): Pfam Name: Methyltransf_2 Pfam Description: O-methyltransferase
  misc_feature (95)..(341): Pfam Name: Methyltransf_2 Pfam Description: O-methyltransferase
  misc_feature (1)..(364): Bit score of 997.5 for HMM based on sequences of FIGURE 17.
  misc_feature (1)..(364): Functional Homolog Of Ceres ANNOT ID no. 869854 at SEQ ID NO. 342

SEQ ID NO: 757 - protein, 364 aa, Thalictrum tuberosum; identical to SEQ ID NO: 480
  misc_feature (1)..(364): Public GI ID no.4808522
  misc_feature (1)..(364): Bit score of 995.0 for HMM based on sequences of FIGURE 17.
  misc_feature (35)..(86): Pfam Name: Dimerisation Pfam Description: Dimerisation domain
  misc_feature (95)..(341): Pfam Name: Methyltransf_2 Pfam Description: O-methyltransferase
  misc_feature (95)..(341): Pfam Name: Methyltransf_2 Pfam Description: O-methyltransferase
  misc_feature (1)..(364): Bit score of 995 for HMM based on sequences of FIGURE 17.
  misc_feature (1)..(364): Functional Homolog Of Ceres ANNOT ID no. 869854 at SEQ ID NO. 342

SEQ ID NO: 758 - protein, 362 aa, Thalictrum tuberosum; identical to SEQ ID NO: 482
  misc_feature (1)..(362): Public GI ID no.4808526
  misc_feature (1)..(362): Bit score of 994.6 for HMM based on sequences of FIGURE 17.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(362): Bit score of 994.6 for HMM based on sequences of FIGURE 17.
  misc_feature (1)..(362): Functional Homolog Of Ceres ANNOT ID no. 869854 at SEQ ID NO. 342

SEQ ID NO: 759 - protein, 362 aa, Thalictrum tuberosum; identical to SEQ ID NO: 478
  misc_feature (1)..(362): Public GI ID no.4808530
  misc_feature (1)..(362): Bit score of 993.9 for HMM based on sequences of FIGURE 17.
  misc_feature (33)..(84): Pfam Name: Dimerisation Pfam Description: Dimerisation domain
  misc_feature (93)..(339): Pfam Name: Methyltransf_2 Pfam Description: O-methyltransferase
  misc_feature (93)..(339): Pfam Name: Methyltransf_2 Pfam Description: O-methyltransferase
  misc_feature (1)..(362): Bit score of 993.9 for HMM based on sequences of FIGURE 17.
  misc_feature (1)..(362): Functional Homolog Of Ceres ANNOT ID no. 869854 at SEQ ID NO. 342

SEQ ID NO: 760 - protein, 359 aa, Capsicum chinense; identical to SEQ ID NO: 483
  misc_feature (1)..(359): Public GI ID no.29839258
  misc_feature (1)..(359): Bit score of 1007.1 for HMM based on sequences of FIGURE 17.
  misc_feature (30)..(81): Pfam Name: Dimerisation Pfam Description: Dimerisation domain
  misc_feature (90)..(336): Pfam Name: Methyltransf_2 Pfam Description: O-methyltransferase
  misc_feature (90)..(336): Pfam Name: Methyltransf_2 Pfam Description: O-methyltransferase
  misc_feature (1)..(359): Bit score of 1007.1 for HMM based on sequences of FIGURE 17.
  misc_feature (1)..(359): Functional Homolog Of Ceres ANNOT ID no. 869854 at SEQ ID NO. 342

SEQ ID NO: 761 - protein, 365 aa, Boehmeria nivea; identical to SEQ ID NO: 484
  misc_feature (1)..(365): Public GI ID no.109255537
  misc_feature (1)..(365): Bit score of 1061.5 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(365): Bit score of 1061.5 for HMM based on sequences of FIGURE 17.
  misc_feature (1)..(365): Functional Homolog Of Ceres ANNOT ID no. 869854 at SEQ ID NO. 342

SEQ ID NO: 762 - protein, 360 aa, Populus tomentosa; identical to SEQ ID NO: 486
  misc_feature (1)..(360): Public GI ID no.7528266
  misc_feature (1)..(360): Bit score of 1053.0 for HMM based on sequences of FIGURE 17.
  misc_feature (34)..(85): Pfam Name: Dimerisation Pfam Description: Dimerisation domain
  misc_feature (94)..(340): Pfam Name: Methyltransf_2 Pfam Description: O-methyltransferase
  misc_feature (94)..(340): Pfam Name: Methyltransf_2 Pfam Description: O-methyltransferase
  misc_feature (1)..(360): Bit score of 1053 for HMM based on sequences of FIGURE 17.
  misc_feature (1)..(360): Functional Homolog Of Ceres ANNOT ID no. 869854 at SEQ ID NO. 342

SEQ ID NO: 763 - protein, 362 aa, Saccharum hybrid cultivar; identical to SEQ ID NO: 487
  misc_feature (1)..(362): Public GI ID no.34398680
  misc_feature (1)..(362): Bit score of 935.1 for HMM based on sequences of FIGURE 17.
  misc_feature (31)..(85): Pfam Name: Dimerisation Pfam Description: Dimerisation domain
  misc_feature (94)..(339): Pfam Name: Methyltransf_2 Pfam Description: O-methyltransferase
  misc_feature (94)..(339): Pfam Name: Methyltransf_2 Pfam Description: O-methyltransferase
  misc_feature (1)..(362): Bit score of 935.1 for HMM based on sequences of FIGURE 17.
  misc_feature (1)..(362): Functional Homolog Of Ceres ANNOT ID no. 869854 at SEQ ID NO. 342

SEQ ID NO: 764 - protein, 355 aa, Thalictrum flavum subsp. glaucum; identical to SEQ ID NO: 489
  misc_feature (1)..(355): Public GI ID no.51980212
  misc_feature (1)..(355): Bit score of 663.5 for HMM based on sequences of FIGURE 17.
  misc_feature (23)..(74): Pfam Name: Dimerisation Pfam Description: Dimerisation domain
  misc_feature (84)..(325): Pfam Name: Methyltransf_2 Pfam Description: O-methyltransferase
  misc_feature (1)..(355): Bit score of 663.5 for HMM based on sequences of FIGURE 17.
  misc_feature (1)..(355): Functional Homolog Of Ceres ANNOT ID no. 869854 at SEQ ID NO. 342

SEQ ID NO: 765 - protein, 363 aa, Isatis indigotica; identical to SEQ ID NO: 490
  misc_feature (1)..(363): Public GI ID no.74053618
  misc_feature (1)..(363): Bit score of 847.6 for HMM based on sequences of FIGURE 17.
  misc_feature (33)..(82): Pfam Name: Dimerisation Pfam Description: Dimerisation domain
  misc_feature (93)..(338): Pfam Name: Methyltransf_2 Pfam Description: O-methyltransferase
  misc_feature (1)..(363): Bit score of 847.6 for HMM based on sequences of FIGURE 17.
  misc_feature (1)..(363): Functional Homolog Of Ceres ANNOT ID no. 869854 at SEQ ID NO. 342

SEQ ID NO: 766 - protein, 371 aa, Rosa chinensis var. spontanea; identical to SEQ ID NO: 664
  misc_feature (1)..(371): Public GI ID no.47232556
  misc_feature (1)..(371): Bit score of 909.7 for HMM based on sequences of FIGURE 17.
  misc_feature (100)..(348): Pfam Name: Methyltransf_2 Pfam Description: O-methyltransferase
  misc_feature (40)..(91): Pfam Name: Dimerisation Pfam Description: Dimerisation domain
  misc_feature (1)..(371): Bit score of 909.7 for HMM based on sequences of FIGURE 17.
  misc_feature (1)..(371): Functional Homolog Of Ceres ANNOT ID no. 869854 at SEQ ID NO. 342

SEQ ID NO: 767 - DNA, 1281 bp, Populus balsamifera subsp. trichocarpa
  misc_feature (1)..(1281): Ceres ANNOT ID no.1441963
  misc_feature (1)..(1281): Encodes the peptide sequence at SEQ ID NO 768
atggagcacagtagattctactaccatgtttcactcatcctttccatttcaggtttggtgtttcctgtcatggtgggttctattgggataaattatggtcagattgcaaacaaccttccaacaccagacaatgtaatccctttagtgaaatcaattggggcaacaaaagtgaaactttacgatgcagatccaagagtgcttaaagcatttgctaatacaggggtggaattcatagttggtcttggaaatgagtatttgtcaaagatgagagatccagataaagcacaagcttgggtaaaagcaaatgttcaagcttatttaccagctacaaaaatcacttgcatcaccattggtaatgaaatcttaaccttgaatgacacaagtctaacagacaatctccttcctgcaatgcaaggcattcagacagctttagtgaatttgggacttgataagcaagtctcggttactactgctcattctttggcagttcttgatgtgtcatttccaccttcagctggatcttttcgaaaagatctagtggggagcatcacccccatattgaatttccatgccaagactaattcaccatttttaatcaatgcgtatccctttttcgcattcaagtctaaccccaaacaagtttctttagattttgtgttgtttcagccaaatcaaggggttgttgatccgaaaagcaacttccattatgataatatgctgtttgctcaaattgatgctgtgtattctgcattagcaagtttaggatacagtaaattgccagttcacatatcagaaactggctggccatcaaaaggtgatgaagatgaagtaggagcaaccctcgaaaatgctaagaaatataacgggaacttgtttaagacaatttgtcaaaggaagggaaccccaatgaggcctaatacagatttgaacatttatgtttttgctttgtttaatgaaaacatgaagcctggaccaacttctgagaggaattatgggttgtttaagcctgatggatcgccagcttatctgcttggaattaatggaactgatgctattagcactaactccacccccaccactgccgccaccaccaccaccactcctgcaccgcgctcgccggagagttcttcaactgggtatttgtcaatttctgctgctgtaaagcaagccattcaatccaattgctttcgatttgttcatgtctggatctacaggaagatggatcagttgcataggccagctactgtttccattgctgttgttgagctgcttggcctttag

SEQ ID NO: 768 - protein, 426 aa, Populus balsamifera subsp. trichocarpa
  misc_feature (1)..(426): Ceres ANNOT ID no.1441963
  misc_feature (1)..(426): Bit score of 891.2 for HMM based on sequences of FIGURE 20.
  misc_feature (28)..(346): Pfam Name: Glyco_hydro_17 Pfam Description: Glycosyl hydrolases family 17
  misc_feature (1)..(426): Bit score of 891.2 for HMM based on sequences of FIGURE 20.
  misc_feature (1)..(426): Functional Homolog Of Ceres CLONE ID no. 11988 at SEQ ID NO. 342
MEHSRFYYHVSLILSISGLVFPVMVGSIGINYGQIANNLPTPDNVIPLVKSIGATKVKLYDADPRVLKAFANTGVEFIVGLGNEYLSKMRDPDKAQAWVKANVQAYLPATKITCITIGNEILTLNDTSLTDNLLPAMQGIQTALVNLGLDKQVSVTTAHSLAVLDVSFPPSAGSFRKDLVGSITPILNFHAKTNSPFLINAYPFFAFKSNPKQVSLDFVLFQPNQGVVDPKSNFHYDNMLFAQIDAVYSALASLGYSKLPVHISETGWPSKGDEDEVGATLENAKKYNGNLFKTICQRKGTPMRPNTDLNIYVFALFNENMKPGPTSERNYGLFKPDGSPAYLLGINGTDAISTNSTPTTAATTTTTPAPRSPESSSTGYLSISAAVKQAIQSNCFRFVHVWIYRKMDQLHRPATVSIAVVELLGL

SEQ ID NO: 769 - DNA, 1230 bp, Populus balsamifera subsp. trichocarpa
  misc_feature (1)..(1230): Ceres ANNOT ID no.1467144
  misc_feature (1)..(1230): Encodes the peptide sequence at SEQ ID NO 770
atggagtactgtagattttactactgtgcttcacttatcctttccatttcaggtttggtatttcctgtaatggtgggttctattgggatcaattatggtcagattgctaacaatcttccagcaccagacaatgtagtccctttagtgaaatcaattggggcaacaaaagtgaaactttatgatgcagatccaagagtgcttaaagcatttgctaatacaggagtggaattcatagttggtcttggaaatgagtacttgtcaaagatgagagatccagaaaaggcacaggcttgggttaaaacaaatgttcaagcttatttaccagcaacaaaaatcacttgcatcacaattggcaatgaagtcttaacctttaatgacacaggtcttacagacaacctcattcctgcaatgcagaacattcacacagctttagtaaatttgggacttgataagcaggtctcagttactacagctcattctttggcaattcttgaagtgtcttatccaccttcagctggatcttttcgaaaagatcttgtggggtgcatcacccccatattgaatttccatgccaagactaactcgccatttttaatcaatgcatatcccttttttgcatacaagtctaatcccaaacaaatttctttagattttgtgctgtttcagccaaatcaagggattgttgattcgaaaagcaatttccattatgataacatgttgtttgctcaaattgatgctgtgcattctgcattagcaagtttaggatacagtaaattgccagttcatatatcagaaactggctggccatcgaaaggggatgcagatgaagtaggagcaaccctcgaaaatgcgaagaaatataatgggaatttgcttaagattatttgtcaaaggaagggaactccaatgaggcctaatacagatttcaacatttatgtttttgctttgtttaatgaaaacatgaaacctggaccagcttctgagaggaattatgggttgtttaagcctgatggaacaccggcatattcgcttggaattagtggaacagatgctgttagtgctaacaccaccaccaccactggtgctcctgcgcctccgtcaccggatagttcttcaactgggtatttgtcaatttctgctgctgtaaaggaaagatgttgtagttgcataggccaactgttgtttccactgctgttgttgaactacttggcctttagactagcattttga

SEQ ID NO: 770 - protein, 409 aa, Populus balsamifera subsp. trichocarpa
  misc_feature (1)..(409): Ceres ANNOT ID no.1467144
  misc_feature (1)..(409): Bit score of 971.2 for HMM based on sequences of FIGURE 20.
  misc_feature (28)..(346): Pfam Name: Glyco_hydro_17 Pfam Description: Glycosyl hydrolases family 17
  misc_feature (1)..(409): Bit score of 971.2 for HMM based on sequences of FIGURE 20.
  misc_feature (1)..(409): Functional Homolog Of Ceres CLONE ID no. 11988 at SEQ ID NO. 342
MEYCRFYYCASLILSISGLVFPVMVGSIGINYGQIANNLPAPDNVVPLVKSIGATKVKLYDADPRVLKAFANTGVEFIVGLGNEYLSKMRDPEKAQAWVKTNVQAYLPATKITCITIGNEVLTFNDTGLTDNLIPAMQNIHTALVNLGLDKQVSVTTAHSLAILEVSYPPSAGSFRKDLVGCITPILNFHAKTNSPFLINAYPFFAYKSNPKQISLDFVLFQPNQGIVDSKSNFHYDNMLFAQIDAVHSALASLGYSKLPVHISETGWPSKGDADEVGATLENAKKYNGNLLKIICQRKGTPMRPNTDFNIYVFALFNENMKPGPASERNYGLFKPDGTPAYSLGISGTDAVSANTTTTTGAPAPPSPDSSSTGYLSISAAVKERCCSCIGQLLFPLLLLNYLAFRLAF

SEQ ID NO: 771 - protein, 470 aa, Medicago truncatula
  misc_feature (1)..(470): Public GI ID no.92867830
  misc_feature (1)..(470): Bit score of 1103.7 for HMM based on sequences of FIGURE 20.
  misc_feature (25)..(344): Pfam Name: Glyco_hydro_17 Pfam Description: Glycosyl hydrolases family 17
  misc_feature (25)..(344): Pfam Name: Glyco_hydro_17 Pfam Description: Glycosyl hydrolases family 17
  misc_feature (381)..(466): Pfam Name: X8 Pfam Description: X8 domain
  misc_feature (1)..(470): Bit score of 1103.7 for HMM based on sequences of FIGURE 20.
  misc_feature (1)..(470): Functional Homolog Of Ceres CLONE ID no. 11988 at SEQ ID NO. 342
MHYFFTLFTFFIFLTFIALTNAGNIGINYGRIANNLPSATKVVQLLKSQGITHVKIYDTDPSVLRALSGSKIKLTVDLPNQQLFAAAKSQSFALSWVERNIVAYQPNTIIEAIAVGNEVFVDPNNSTKYLVPAMKNIYRSLQKHNLHNDIKVSSPIALSALGNSYPSSSGSFRPELIQPVFKPMLDFLRETGSYLMVNVYPFFAYESNADVISLDYALFRENPGQVDAGNGLRYLNLFDAQIDAVFAALSRLKYDDINVVVSETGWPSKGDGNEVGASVENAAAYNANLVRKILTSKGTPLRPKADLTVFLFALFNENQKPGPTSERNFGLFYPDEKKVYNVPLTVEALKNYHDDPSPASPVSGGGGSGGGGVSKSTTGNTWCVANPYADKNKLQDALDFACGEGGADCRPIQNNATCFDPNTLVAHASFAFNSYYQKQARAGGSCYFGGTSYVVTQEPKYGKCEFPTGY

SEQ ID NO: 772 - protein, 453 aa, Pisum sativum
  misc_feature (1)..(453): Public GI ID no.7414433
  misc_feature (1)..(453): Bit score of 1027.2 for HMM based on sequences of FIGURE 20.
  misc_feature (27)..(341): Pfam Name: Glyco_hydro_17 Pfam Description: Glycosyl hydrolases family 17
  misc_feature (369)..(453): Pfam Name: X8 Pfam Description: X8 domain
  misc_feature (1)..(453): Bit score of 1027.2 for HMM based on sequences of FIGURE 20.
  misc_feature (1)..(453): Functional Homolog Of Ceres CLONE ID no. 11988 at SEQ ID NO. 342
MATSTLSPSPLLLLLLLFHLVATVTSIGVNYGTLGDNLPPPATVANFLKTNTIIDSVKIFDVSPQILQAFANTGISVTVTAPNGDIEALAKIDSARQWVVTHIKPFHPQTKINYILVGSEVFHWGDSVMIRNLVPAMRTLHSALLAEGITDIKVTTAHSLAILRQSLPPSAGNSDQDTAKYFIGPMLKFLRQTRTPFMVNPYPYFGYNPKNANFALFRPNRGLFDRNTKLLYTNQFDALMDAVHSAMKALGYGDVDIAVGETGWPSVCDGWDACSVANAQSYNGQLIRHLAEGKGTPLMPNRRFETFIFALFNENQKPGPIAERNWGLFQPDFSSVYDAGILRNGQKPVAPVKGGGKMPTPRPVVGGQKWCVPKADASPGALQANINYVCSQGIDCRPIQPGGVCYAANNVKAIATYAMNAYYQANGKHDYNCDFSHSGVTTSVNPSHDNCRI

SEQ ID NO: 773 - protein, 467 aa, Nicotiana tabacum
  misc_feature (1)..(467): Public GI ID no.11071974
  misc_feature (1)..(467): Bit score of 1093.7 for HMM based on sequences of FIGURE 20.
  misc_feature (24)..(343): Pfam Name: Glyco_hydro_17 Pfam Description: Glycosyl hydrolases family 17
  misc_feature (24)..(343): Pfam Name: Glyco_hydro_17 Pfam Description: Glycosyl hydrolases family 17
  misc_feature (378)..(463): Pfam Name: X8 Pfam Description: X8 domain
  misc_feature (1)..(467): Bit score of 1093.7 for HMM based on sequences of FIGURE 20.
  misc_feature (1)..(467): Functional Homolog Of Ceres CLONE ID no. 11988 at SEQ ID NO. 342
MATFTLPSLFILLSLLSVAHSGSIGINYGRIANNLPSPAQVVQLLKTQGVNRIKLYDTDSNVLTALSGSNISVTVALPNEQLSDAAEKQSFTDSWVQSNILTYYPKTLIESIAVGNEVFVDPKNTTKFLVPAMKNVYASLVKYGVAESIKVSSPVALSALGNSYPSSAGSFKPDLVEPVIKPMLSFLKQTGSYLMVNIYPFFAYAANTDTISLDYALFKDNKGVTDPNNGLVYKSLFEAQIDAVYAALKAVGFGDVAMAVSETGWPSKGDENEAGAGADNAAAYNGNLVRRVLTGSGTPLKPNEPLDVFLFALFNENQKPGPTSERNYGLFYPNEQKVYDITLTKDGLGNGPTMNNGSKSTVVTAPEPALEASKVGNTWCVANEKAAREKLQAALDYACGEGGADCRPIQQGATCYDPDTLEAHASYAFNSYYQKNTRGVSTCDFSGAAYVVTQHPKYGSCKFPTGY

SEQ ID NO: 774 - protein, 402 aa, Solanum tuberosum
  misc_feature (1)..(402): Public GI ID no.419789
  misc_feature (1)..(402): Bit score of 946.9 for HMM based on sequences of FIGURE 20.
  misc_feature (32)..(350): Pfam Name: Glyco_hydro_17 Pfam Description: Glycosyl hydrolases family 17
  misc_feature (1)..(402): Bit score of 946.9 for HMM based on sequences of FIGURE 20.
  misc_feature (1)..(402): Functional Homolog Of Ceres CLONE ID no. 11988 at SEQ ID NO. 342
MMEPNPNPNPNPISSSLLLFLLFFTPTMVAPLGINYGQIANNLPLPENVVPLVKSIGATRIKLYDADPHVLKAFANTGVEFIVSLGNEYLSKMKDPSKAQSWVKNNVQAYLPATKITCIAVGNEVLTFNDTILTDNLLPAMQSVHTALVNLKLDKQVTVTTAHSLAILQTSYPPSAGAFRRDLVNCVTQIVDFHCKTGSPFLINAYPYFAYKGNPKQVSLDFVLFQPNSGIVDPESNLHYDNMLFAQIDAVHSALASIGYKNVCVQISETGWPSKGDADEAGATPENARKYNCNLMKLIGQKKGTPMRPNSDLNIYVFALFNENLKPGPSSERNYGLFKPDGSQAYPLGVPAINAVSTNSSNSGGSGSTLSASVPPASSSSGYLAITSDSVSILASSFSLFL

SEQ ID NO: 775 - protein, 422 aa, Pennisetum glaucum
  misc_feature (1)..(422): Public GI ID no.33321023
  misc_feature (1)..(422): Bit score of 961.7 for HMM based on sequences of FIGURE 20.
  misc_feature (26)..(346): Pfam Name: Glyco_hydro_17 Pfam Description: Glycosyl hydrolases family 17
  misc_feature (1)..(422): Bit score of 961.7 for HMM based on sequences of FIGURE 20.
  misc_feature (1)..(422): Functional Homolog Of Ceres CLONE ID no. 11988 at SEQ ID NO. 342
MALRLVLAAAFAVLAPALAAAGAPALGINYGQVADNLPPPQAAAVLLRALNATKVKLYDADARVLSAFAGSGADFTVGVPDRLVPRFATDPSAAPAWVRANILPHVPATSITAVTVGNEVLTGTDTTMLRSLLPAMEALHAALAACNLTSRVSVTTAHSLGVLSSSFPPSDAAFRRDVLPYMSPILGFLAKTGAPFLINAYPYFAYKADPDGVDLSYALFEPNAGVSDAATGLRYGNMLHAQVDAVRAAICRANYGKALEIRVSETGWPSQGDDDEAGATPENAARYNGNLMRMVMEGKGTPAAPGEALQVYVFALFNEDQKPGPASERHYGLFKPDGTPAYDVGVKAPTISGWKGSGSGSGNGTSGSAGLVVAQGPGGADGVGPGTGFYTVSASANKMKRRWQCAESLLVAAFLAMVSGLC

SEQ ID NO: 776 - protein, 431 aa, Sorghum bicolor
  misc_feature (1)..(431): Public GI ID no.33321014
  misc_feature (1)..(431): Bit score of 937.9 for HMM based on sequences of FIGURE 20.
  misc_feature (32)..(353): Pfam Name: Glyco_hydro_17 Pfam Description: Glycosyl hydrolases family 17
  misc_feature (1)..(431): Bit score of 937.9 for HMM based on sequences of FIGURE 20.
  misc_feature (1)..(431): Functional Homolog Of Ceres CLONE ID no. 11988 at SEQ ID NO. 342
MALHLMLAAAAAFAVLAPPAASSGPTPAPPALGINYGQVADNLPPPQAALLLLRALNATRVKLYDADARVLRAFAGSGVDFTVGVPDRLVPRMATDPSAAASWVRSNLLPHLPATSITAVTVGNEVLSGTNAAMLRSLLPAMESLHAALAACNLTSRVSVTTAHSLAVLSSSFPPSSAAFRREVVPYMAPLLGFLARTGAPFLVNAYPYFAYKADPDRVDLGYALFEANSAGVADAATGLRYDNMLHAMVDAARAAICRANYGKALEIRVSETGWPSQGDDDEAGATPENAARYNGNLMRLVAQGKGTPAAPGEPLQVYVFALFNEDQKPGPASERHYGLFKPDGTPAYDVGVKAPTITLPKGNGSSGSGNNGTGGLVVAQGPGGADGVGPGTGYYTVSAAAMNKVKSRRRRCMESLVAAAAVLAMVSGPC

SEQ ID NO: 777 - DNA, 1366 bp, Zea mays
  misc_feature (1)..(1366): Ceres CLONE ID no.1145901
  misc_feature (1)..(1366): Encodes the peptide sequence at SEQ ID NO 778
gctctctccaytcatctatggcttcttcttctctgcagtctctcttctctctgttttgccttgctctgttctctcttcctctcatcgtctcctccatcggcatcaactatggccaggtcgctaacaaccttcctccccctaaaaacgtcatccctctcctcaagtctgtgggagctacaaaagtcaagctctatgacgccgatccacaagccctacgtgccttcgccggctccggcttcgagctcaccgtggccctcggtaacgagtacctggctcagatgagcgaccctattaaagcccaaggctgggtgaaggagaacgtccaagcttacctcccaaacaccaagatcgtggccatcgtagtgggaaacgaagtcctcacctcaaaccagtcagccctcacggcagccctcttcccggctatgcaaagaatccacggtgctctggtggattgtggcctaaacaagcagatctttgtgacgacggctcactcactagccatcttggatgtatcctaccctccctcggccacttccttccgccgcgacctcctcggctccctcactcccatcttggacttccacgtcaagactggctcaccaatcctcatcaacgcctaccctttcttcgcctacgaagaaaaccccaaacacgtttctctcgacttcgtactcttccaaccaaatcaaggcttcaccgatcctggctctaatttccactacgacaacatgctcttcgctcaggtcgacgcagtctatcacgctcttgacgctgtcggcatcagctacaagaaagttcccattgtcgtctccgagaccggatggccttccaacggtgacccgcaagaagtcggagccacctgcgacaatgctcgcaagtacaatgggaatctgatcaagatgatgatgagcaagaagatgaggacgcctattcgacctgagtgcgatctcaccatcttcgtctttgctctctttaacgagaacatgaagcctggaccaacctccgagaggaactacggtctcttcaaccctgacggaactccggtttactcacttgggatcaagacctcttccactcatagtagtggtagtggtagcagcaactccactggtggtagtagcagtggcggtggcggtaacactggtggctcttccagcggtggtggcatctatcagccagtcacgggtaacccatcaccggattacatgtccatttcctccgccgggggaaaaggcagattcgttgagtgtgtgttgttcttcttcttgctttgcatcatcaagcttcggttgtaaaagcttctccactagatctcgtcggctttgtacttttacgcggttgatgacgtgatatagcccccaaattt

SEQ ID NO: 778 - protein, 425 aa, Zea mays; identical to SEQ ID NO: 282
  misc_feature (1)..(425): Ceres CLONE ID no.1145901
  misc_feature (1)..(425): Bit score of 1028.0 for HMM based on sequences of FIGURE 20.
  misc_feature (27)..(348): Pfam Name: Glyco_hydro_17 Pfam Description: Glycosyl hydrolases family 17
  misc_feature (1)..(425): Bit score of 1028 for HMM based on sequences of FIGURE 20.
  misc_feature (1)..(425): Functional Homolog Of Ceres CLONE ID no. 11988 at SEQ ID NO. 342

SEQ ID NO: 779 - DNA, 1736 bp, Panicum virgatum
  misc_feature (1)..(1736): Ceres CLONE ID no.1876038
  misc_feature (1)..(1736): Encodes the peptide sequence at SEQ ID NO 780
ctcgctcttcccactcgcccactcgctccaagccacctgatccaagagctcgagctcctccctgcctctgcgaccacaatgccctcacgcgcaatggcggcgctcatccctctcctgccagccctgctcctcctgctcccgtccaccccggaggccacgtcctcggcgctgctgggcatcagctacggccgcgttggcaacaacctcccgccggccacctccgtgccgcggatcctcgcctccctcggtgtcggccgcgtccgcctctacgacgccgaccccgccaccatccgcgccttcgccaacacgggcgtcgagctcgccgttggcgtcccggacgagtgcctcgcggcggtctccacccccaccggcgccgcctcctgggtccgctccaacattgcccccgcgctcccggccaccaagatcgccttcctcaccgtcggcaacgaggtgctcaccggcgccaacagctcctcgctgtccaggtacctcctcccggcgatgcagtgcctccacgacgcgctcgcgcaggccggcctcgacaagaagatcgccgtcaccaccgcgcacaacctcggcgtgctggcgacgtcgtacccaccctcgtcggcctacttccgcaaggacctcctcccggtgctctgccccatcctcgacttccacgcgcgcgccggctcgccgttcctcgtcaatgcgtacccctacttcgcctacgccgaggagcccaccggcgtggagctcgagtacgcgctgctggagcccggccacgccggcgtcgccgacccggggtccgggctgcactacaccaacatgctcgccgcgcaggtggacgccgtgtaccacgccatcggggcggccaacagcgcggcggcgcgggccgtggaggtgcgcgtgtccgagaccgggtggccgtcggcgggcgacgccaacgagaccggcgccacgccgcagaacgccgcgagatacaacggcaacgtgatgcggctcgtggcccaggggaagggcacgccgctgcgcccgtcgatgccgctgcgcgtctacatgttcgcgctcttcaacgagaacatgaagcccgggccggcctccgagcgcaactacgggctcttcaagcccgacggcacgccggcgtacgagctctcctaccgcctgccgcaggacaacaacacctcctccggcagcagcagcggcattgccggcggtggcgtgtacaatggccacggctacggatcggagaacggcggatactacagcatctcggccgccggcaaggcaacaatgggttggtggacatgggcacaggcagctgcggcagcatgtgtagttgtcctggtgatgcaattgtggctgtgagcagatcacgcgatgtggttggatggatggaagcctctggtttctaatggagtccgaggctggtagggccacagtggggaagaaccgctgctgctgtcgacaaaggcattgatcatggtgatgaacaaaggttgttgtaattgaggtgcccttgtagttggcggtaagctaatgcgtttagccggtgccattaaactaattatctttttaatgtttgttgttttgagatttagatctttttttgaggtgagggtactaatacgagtggaatgaagtattccacttggaattgtgtaaaagtgtcttggtaatgactcataaaaaatggatcacatggagaacatgtatcacctggtcttttatttcaaaaaaaaaaaaaaaaaaaa

SEQ ID NO: 780 - protein, 423 aa, Panicum virgatum
  misc_feature (1)..(423): Ceres CLONE ID no.1876038
  misc_feature (1)..(423): Bit score of 952.4 for HMM based on sequences of FIGURE 20.
  misc_feature (32)..(355): Pfam Name: Glyco_hydro_17 Pfam Description: Glycosyl hydrolases family 17
  misc_feature (1)..(423): Bit score of 952.4 for HMM based on sequences of FIGURE 20.
  misc_feature (1)..(423): Functional Homolog Of Ceres CLONE ID no. 11988 at SEQ ID NO. 342
MPSRAMAALIPLLPALLLLLPSTPEATSSALLGISYGRVGNNLPPATSVPRILASLGVGRVRLYDADPATIRAFANTGVELAVGVPDECLAAVSTPTGAASWVRSNIAPALPATKIAFLTVGNEVLTGANSSSLSRYLLPAMQCLHDALAQAGLDKKIAVTTAHNLGVLATSYPPSSAYFRKDLLPVLCPILDFHARAGSPFLVNAYPYFAYAEEPTGVELEYALLEPGHAGVADPGSGLHYTNMLAAQVDAVYHAIGAANSAAARAVEVRVSETGWPSAGDANETGATPQNAARYNGNVMRLVAQGKGTPLRPSMPLRVYMFALFNENMKPGPASERNYGLFKPDGTPAYELSYRLPQDNNTSSGSSSGIAGGGVYNGHGYGSENGGYYSISAAGKATMGWWTWAQAAAAACVVVLVMQLWL

SEQ ID NO: 781 - protein, 416 aa, Oryza sativa subsp. indica
  misc_feature (1)..(416): Public GI ID no.125531206
  misc_feature (1)..(416): Bit score of 950.2 for HMM based on sequences of FIGURE 20.
  misc_feature (26)..(349): Pfam Name: Glyco_hydro_17 Pfam Description: Glycosyl hydrolases family 17
  misc_feature (1)..(416): Bit score of 950.2 for HMM based on sequences of FIGURE 20.
  misc_feature (1)..(416): Functional Homolog Of Ceres CLONE ID no. 11988 at SEQ ID NO. 342
MPPLILVMAALLLLPAAANATSSALLGINYGRVGNNLPPANAVPPMLSSLGVGRVRLYDADPATLRAFANTGVELVVGVPDECLAAVSTPSGAASWVRSVVQPALPATKIAVLTVGNEVLTGANSSSLSRSLLPAMQCLHDALAQLGLDKQVAVTTAHNLGVLATSYPPSSAYFRKDLLPLLCPILDFHARTGSPFLVNAYPYFAYAEDPTGVELEYALLEPTYAGVADPSSGLHYPNLLVAQVDAVYHAIAAANTAAARAVEVRVSETGWPSAGDANETGATPQNAARYNGNVMRLVADGKGTPLRPSVALRAYMFALFNENMKPGPTSERNYGLFKPDGTPVYELAYSLPKDNTNSGGGGGGGIGGGSGTIGGGGEYNGHGEDGGYYSISASAKPAVKLSSALLLIMLHNFYVL

SEQ ID NO: 782 - protein, 443 aa, Oryza sativa subsp. indica
  misc_feature (1)..(443): Public GI ID no.125561574
  misc_feature (1)..(443): Bit score of 757.3 for HMM based on sequences of FIGURE 20.
  misc_feature (36)..(358): Pfam Name: Glyco_hydro_17 Pfam Description: Glycosyl hydrolases family 17
  misc_feature (1)..(443): Bit score of 757.3 for HMM based on sequences of FIGURE 20.
  misc_feature (1)..(443): Functional Homolog Of Ceres CLONE ID no. 11988 at SEQ ID NO. 342
MAPPSCLLRVGWLPAALCALALALAPASDATSASLVGINYGRVGSNLPPPQAVLPLLEGLGIGRVRLYDADPAVLHAFAKTGVELFVGVPDQSLAGLADPGGADSWLRSNVMPFLPDTKIAALTVGNEVLTGNNSAVTRALLPAMQSLHGALAKLGLDKQIAVTTAHNLGVLGTSYPPSSGAFRRDLLPYICPILDYHARTGSPFLVNAYPYFAYSGDPKGIHLEYALLEAGYAGVPDPNSGLRYPNLLVAQVDAVYHAIAAANTAAARVVEVRISETGWPSSGDPGETAATPQNAARYNSNAMRLVAEGKGTPLKPTVAMRAYVFALFNENLKPGLASERNYGLFKPDGTPVYELSYKLPRDNSTFGGAGNSGWRFPGGGGGNVSGGYDNNGVNSGYYDISAASPDSAMVTSGSGRSNGCPGGSSVRSSSGVNSRLDGRKLG

SEQ ID NO: 783 - protein, 418 aa, Oryza sativa subsp. japonica
  misc_feature (1)..(418): Public GI ID no.22655795
  misc_feature (1)..(418): Bit score of 943.9 for HMM based on sequences of FIGURE 6.
  misc_feature (25)..(348): Pfam Name: Glyco_hydro_17 Pfam Description: Glycosyl hydrolases family 17
  misc_feature (1)..(418): Functional Homolog Of Ceres CLONE ID no. 11988 at SEQ ID NO. 342
MPPLILVMAALLLPAAADATSSVLLGINYGRVGNNLPPANAVPPMLSSLGVGRVRLYDADPATLRAFANTGVELVVGVPDECLAAVSTPSGAASWVRSVVQPALPATKIAVLTVGNEVLTGANSSSLSRSLLPAMQCLHDALAQLGLDKQVAVTTAHNLGVLATSYPPSSAYFRKDLLPLLCPILDFHARTGSPFLVNAYPYFAYAEDPTGVELEYALLEPTYAGVADPSSGLHYPNLLVAQVDAVYHAIAAANTAAARAVEVRVSETGWPSAGDANETGATPQNAARYNGNVMRLVADGKGTPLRPSVALRAYMFALFNENMKPGPTSERNYGLFKPDGTPVYELSYRLPKDNTNSGGGGGGIGGGSGTIGGGGEYNGHGEDGGYYSISASAKPADNLKSVVFIMLGAFANTRNVKA

SEQ ID NO: 784 - protein, 420 aa, Oryza sativa subsp. japonica
  misc_feature (1)..(420): Public GI ID no.115481224
  misc_feature (1)..(420): Bit score of 948.2 for HMM based on sequences of FIGURE 6.
  misc_feature (25)..(348): Pfam Name: Glyco_hydro_17 Pfam Description: Glycosyl hydrolases family 17
  misc_feature (1)..(420): Functional Homolog Of Ceres CLONE ID no. 11988 at SEQ ID NO. 342
MPPLILVMAALLLPAAADATSSVLLGINYGRVGNNLPPANAVPPMLSSLGVGRVRLYDADPATLRAFANTGVELVVGVPDECLAAVSTPSGAASWVRSVVQPALPATKIAVLTVGNEVLTGANSSSLSRSLLPAMQCLHDALAQLGLDKQVAVTTAHNLGVLATSYPPSSAYFRKDLLPLLCPILDFHARTGSPFLVNAYPYFAYAEDPTGVELEYALLEPTYAGVADPSSGLHYPNLLVAQVDAVYHAIAAANTAAARAVEVRVSETGWPSAGDANETGATPQNAARYNGNVMRLVADGKGTPLRPSVALRAYMFALFNENMKPGPTSERNYGLFKPDGTPVYELSYRLPKDNTNSGGGGGGIGGGSGTIGGGGEYNGHGEDGGYYSISASAKPAGWWTWWTQAAVAACVAVLMRMMAL

SEQ ID NO: 785 - protein, 430 aa, Oryza sativa subsp. japonica
  misc_feature (1)..(430): Public GI ID no.115451885
  misc_feature (1)..(430): Bit score of 769.5 for HMM based on sequences of FIGURE 6.
  misc_feature (36)..(358): Pfam Name: Glyco_hydro_17 Pfam Description: Glycosyl hydrolases family 17
  misc_feature (1)..(430): Functional Homolog Of Ceres CLONE ID no. 11988 at SEQ ID NO. 342
MAPPSCLLRVGWLPAALCALALALAPASDATSASLVGINYGRVGSNLPPPQAVLPLLEGLGIGRVRLYDADPAVLHAFAKTGVELFVGVPDQSLAGLADPGGADSWLRSNVMPFLPDTKIAALTVGNEVLTGNNSAVTRALLPAMQSLHGALAKLGLDKQIAVTTAHNLGVLGTSYPPSSGAFRRDLLPYICPILDYHARTGSPFLVNAYPYFAYSGDPKGIHLEYALLEAGYAGVPDPNSGLRYPNLLVAQVDAVYHAIAAANTAAAQVVEVRISETGWPSSGDPGETAATPQNAARYNSNAMRLVAEGKGTPLKPTVAMRAYVFALFNENLKPGLASERNYGLFKPDGTPVYELSYKLPRDNSTFGGAGNSGWRFPGGGGGNVSGGYDNNGVNSGYYDISAASPDSAGPCRWSQAAVAGAMAVLVVAA

SEQ ID NO: 786 - protein, 429 aa, Oryza sativa subsp. japonica
  misc_feature (1)..(429): Public GI ID no.125585592
  misc_feature (1)..(429): Bit score of 710.3 for HMM based on sequences of FIGURE 6.
  misc_feature (36)..(347): Pfam Name: Glyco_hydro_17 Pfam Description: Glycosyl hydrolases family 17
  misc_feature (1)..(429): Functional Homolog Of Ceres CLONE ID no. 11988 at SEQ ID NO. 342
MAPPSCLLRVGWLPAALCALALALAPASDATSASLVGINYGRVGSNLPPPQAVLPLLEGLGIGRVRLYDADPAVLHAFAKTGVELFVGVPDQSLAGLADPGGADSWLRIAALTVGNEVLTGNNSAVTRALLPAMQSLHGALAKLGLDKQIAVTTAHNLGVLGTSYPPSSGAFRRDLLPYICPILDYHARTGSPFLVNAYPYFAYSGDPKGIHLEYALLEAGYAGVPDPNSGLRYPNLLVAQVDAVYHAIAAANTAAAQVVEVRISETGWPSSGDPGETAATPQNAARYNSNAMRLVAEGKGTPLKPTVAMRAYVFALFNENLKPGLASERNYGLFKPDGTPVYELSYKLPRDNSTFGGAGNSGWRFPGGGGGNVSGGYDNNGVNSGYYDISAASPDSAVRSTLPPSRLFVPALHGSGIDLPVVLFLKRR

SEQ ID NO: 787 - DNA, 1295 bp, Gossypium hirsutum
  misc_feature (1)..(1295): Ceres CLONE ID no.1848247
  misc_feature (1)..(1295): Encodes the peptide sequence at SEQ ID NO 788
agcaatggaaagcaccgactcctccaccgtctcgcagcggccgaacctcccaccagggttcaggttccaccccacggatgaagagctagtcgtccactatctaaagaaaaaggctacctcagcccctctaccggttgcaataattgcagaagttgatttgtataagtttgatccatgggaattaccagctaaggctacgtttggcgagcgtgaatggtacttctttagccctagagacaggaagtatccgaacggagcgaggcctaacagggcggcaacttcgggttattggaaggctaccggcaccgataagccggtattaaactcgaaagggacacaaaaggttggtgtgaagaaggcactggttttctatggagggaagcctcctaaagggatcaaaacaaattggatcatgcatgaatataggcttcctgataataagaataacaacaaaccccctggatgtgacttgggatacaagaaaaactcactaaggcttgatgattgggtgctatgtagaatctacaagaaaaacaacacaaatagacccttgggatatgaaaaagatgaggccatggatgatatgggtgggccagtaccaacttcaatgtcaattggcagtcttcagttccagacaaagggcacaagttgtggaacatttcttgaaaatcatgaacataacctgtttgatggaatgctggggagtgatgggatgaataacaatggttcgatgtctcacttaggacgttgttcaagctcaaagccagacctgtctatggttaaccctctcaaaagaagtaccgtcccatcgctttactggaccgatgaggatacagccagtccttcaacaagcaagacatttcatggggatcatagcaatgatggaagcctggaaaaaccagacacaaatggctcaaattcaattgcaaccctgcttagccagcttcctcaaacccctcacctgcaacaacaaacaatggtagggtcaatggaggatgggatttttcgaccttcatatcaacttccaggcctcaactggtacactcttaattgaattttcaggtactggggtattctgtaggtttaccatttttatgcccttgaagaaaatattccaaattttcaactagcttagggaactttcatcagtgtcatgttttacctacttgttggtagggaaagagatcgatgagccaaagtttcaactcttgagccatagatatagttaaatttttattaatatctagtgttatacatatacatatagtttgatgtaaaaaaaaaaaaaaaaaaaa

SEQ ID NO: 788 - protein, 349 aa, Gossypium hirsutum
  misc_feature (1)..(349): Ceres CLONE ID no.1848247
  misc_feature (1)..(349): Bit score of 710.0 for HMM based on sequences of FIGURE 7.
  misc_feature (15)..(143): Pfam Name: NAM Pfam Description: No apical meristem (NAM) protein
  misc_feature (1)..(349): Functional Homolog Of Ceres CLONE ID no. 21243 at SEQ ID NO. 342
MESTDSSTVSQRPNLPPGFRFHPTDEELVVHYLKKKATSAPLPVAIIAEVDLYKFDPWELPAKATFGEREWYFFSPRDRKYPNGARPNRAATSGYWKATGTDKPVLNSKGTQKVGVKKALVFYGGKPPKGIKTNWIMHEYRLPDNKNNNKPPGCDLGYKKNSLRLDDWVLCRIYKKNNTNRPLGYEKDEAMDDMGGPVPTSMSIGSLQFQTKGTSCGTFLENHEHNLFDGMLGSDGMNNNGSMSHLGRCSSSKPDLSMVNPLKRSTVPSLYWTDEDTASPSTSKTFHGDHSNDGSLEKPDTNGSNSIATLLSQLPQTPHLQQQTMVGSMEDGIFRPSYQLPGLNWYTLN

SEQ ID NO: 789 - protein, 320 aa, Arabidopsis thaliana
  misc_feature (1)..(320): Public GI ID no.20466640
  misc_feature (1)..(320): Bit score of 618.1 for HMM based on sequences of FIGURE 7.
  misc_feature (17)..(147): Pfam Name: NAM Pfam Description: No apical meristem (NAM) protein
  misc_feature (1)..(320): Functional Homolog Of Ceres CLONE ID no. 21243 at SEQ ID NO. 342
MESTDSSGGPPPPQPNLPPGFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCRIYKKNNSTASRHHHHLHHIHLDNDHHRHDMMIGDDRFRHVPPGLHFPAIFSDNNDPTAIYDGGGGGYGGGSYSMNHCFASGSKQEQLFPPVMMMTSLNQDSGIGSSSSPSKRFNGGGVGDCSTSMAATPLMQNQGGIYQLPGLNWYS

SEQ ID NO: 790 - protein, 285 aa, Brassica napus
  misc_feature (1)..(285): Public GI ID no.31322578
  misc_feature (1)..(285): Bit score of 582.8 for HMM based on sequences of FIGURE 7.
  misc_feature (6)..(131): Pfam Name: NAM Pfam Description: No apical meristem (NAM) protein
  misc_feature (1)..(285): Functional Homolog Of Ceres CLONE ID no. 21243 at SEQ ID NO. 342
MSELQLPPGFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSSAARKKKNSLRLDDWVLCRIYNKKGAIEKRGPPPTPVVYGDEVVEEKPRLSEMGMPPPPVMPNDFVYFDTSDSVPKLHTTESSCSEQVVSPEFTSEVQSEPKWKDWSGEKSSLDFGFNYIDATAFGGGGGSNQLFPLQDMFMYNMPKPY

SEQ ID NO: 791 - protein, 286 aa, Brassica napus
  misc_feature (1)..(286): Public GI ID no.31322576
  misc_feature (1)..(286): Bit score of 578.4 for HMM based on sequences of FIGURE 7.
  misc_feature (6)..(131): Pfam Name: NAM Pfam Description: No apical meristem (NAM) protein
  misc_feature (1)..(286): Functional Homolog Of Ceres CLONE ID no. 21243 at SEQ ID NO. 342
MSELQLPPGFRFHPTDEELVMHYLCRKCASQSIAVPIIAEIDLYKYNPWELPGLALYGEKEWYFFSPRDRKYPNGSRPNRSAGSGYWKATGADKPIGLPKPVGIKKALVFYAGKAPKGEKTNWIMHEYRLADVDRSAARKKKNSLRLDDWVLCRIYNKKGAIEKRGPPPTPVVYGDEVVEEKPRLSEMGMPPPPVMPNDFVYFDTSDSVPKLHTTESSCSEQVVSPEFTSEVQSEPKWKDWSGAANDKNSLDFGFNYIDATAFGGVGSNQLFPLQDMFMYNMPKPY

SEQ ID NO: 792 - protein, 363 aa, Prunus persica
  misc_feature (1)..(363): Public GI ID no.63252923
  misc_feature (1)..(363): Bit score of 699.9 for HMM based on sequences of FIGURE 7.
  misc_feature (26)..(154): Pfam Name: NAM Pfam Description: No apical meristem (NAM) protein
  misc_feature (1)..(363): Functional Homolog Of Ceres CLONE ID no. 21243 at SEQ ID NO. 342
MESTDSSTASQQQQQQQPQPPPQPNLPPGFRFHPTDEELVVHYLKKKVTSAPLPVAIIAEIELYKFDPWELPAKATFGEQEWYFFSPRDRKYPNGARPNRAATSGYWKATGTDKPVLTSGGTQKVGVKKALVFYGGKPPKGIKTNWIMHEYRLADSKTSNKPPGCDLGNKKNSLRLDDWVLCRIYKKNNSHRPMDLEREDSMEDMMGPLMPPSISHVGHHQNMNLHLPKSNTNYGPPFIENDQIIFDGIMSSTDGSASLSNGTSQLPLKRSIVPSLYRNDQEDDQTAGASSSKRVVQLHQLDSGTNNSVAANNNSTSIANLLSQLPQTPPLHQHAMLGSLGDGLFRTPYQLPGMNWFSESNLG

SEQ ID NO: 793 - DNA, 1699 bp, Glycine max
  misc_feature (1)..(1699): Ceres CLONE ID no.467981
  misc_feature (1)..(1699): Encodes the peptide sequence at SEQ ID NO 794
gtgtgttgttctcttcttcttgtgtgaagccaaagccacaacaacaaccattggaacaacccaacaacatagtgaacaacaaccttggtaataataaccatggagagcaccgaagactcatccacgagttcacagcaacaaccgaacctgccacccgggtttcggttccaccccacagacgaggagctcgtggttcattacctcaagaagaaagtagattctgttcctctccctgtttcaatcatcgctgatgttgatctctacaagtttgatccatgggaattaccagccaaagcatcgtttggggcggaagagtggtactttttcagcccgagagaaaggaagtacccgaatggcgcgaggccaaacagggctgcaacttcagggtattggaaagccacggggacagataagcctatatgtagtggaactcaaaaggttggggtgaagaaatctttggttttctatggagggaagccaccaaaaggggtaaaaaccgattggatcatgcatgagtaccgtgttactgaaaacaagccaaacaataggcctcctgggtgtgacttgggccacaagaaaaactccctaaggctggatgattgggtgttgtgccgaatctacaagaagggcaacacacaaaggtcacatgagagggacgattccattgatgacatgattggagaagtacctccttccatcaacgtgggccacatgagtgcgaggtttcacctttcaaggatgtccacgagctacagtggtgcattgttggaaaatgacagaaacacgttagaaggggtggttataggcaatggtagtgtgaatgggatcagcaatactaataatattacaagtgtcatatcatcatctcatcagtttggcacctcaaactccaaggcagagcttcttccttttgtcccttcaaacaacacttctaattcggcctccaaaagaacactctcatcactctattggaatgttgatgatcacaaacacttcaatttggacagtaatgggaatgtgagtgttttgaggacagatcaagagaataataataataataatggtacttctggctcctttgctactctgcttaaccagcttccacaaacaccttcattgccccaaatagatgggttacttcggacaccgtatcaaatacaagggaccaattggtatggttaattccattttgaggggtatgcttgatatgataatttcataattataatgcacaaggagatcaaattgaactaaggtgtggcaagggatcctcaacttgtgctagattgcaaggattttaaaagggtcattgagattgtggtttaattgttaggagaatggaagaatgttagagcacactaatcaatgttttctttcaaccatttgcaggtagctaagggcaattaataccacatgaggtgagggtgtaagaccttggaacttttagtttaattattatatagatcggtatagtaacatagataaagatagatatatagaagcatatttgcttgttttattagtgtgtaaagaaacaaaatgagggtaaaaactttcgagagaggataaaagaaagagttagccacagttctatatatatatactttgctttatgatacagaatgaagagtatagaaaatatacttcagaacgatataaattgatgcaagattttaaaatatgtatattgattgtattc

SEQ ID NO: 794 - protein, 360 aa, Glycine max
  misc_feature (1)..(360): Ceres CLONE ID no.467981
  misc_feature (1)..(360): Bit score of 686.7 for HMM based on sequences of FIGURE 7.
  misc_feature (17)..(143): Pfam Name: NAM Pfam Description: No apical meristem (NAM) protein
  misc_feature (1)..(360): Functional Homolog Of Ceres CLONE ID no. 21243 at SEQ ID NO. 342
MESTEDSSTSSQQQPNLPPGFRFHPTDEELVVHYLKKKVDSVPLPVSIIADVDLYKFDPWELPAKASFGAEEWYFFSPRERKYPNGARPNRAATSGYWKATGTDKPICSGTQKVGVKKSLVFYGGKPPKGVKTDWIMHEYRVTENKPNNRPPGCDLGHKKNSLRLDDWVLCRIYKKGNTQRSHERDDSIDDMIGEVPPSINVGHMSARFHLSRMSTSYSGALLENDRNTLEGVVIGNGSVNGISNTNNITSVISSSHQFGTSNSKAELLPFVPSNNTSNSASKRTLSSLYWNVDDHKHFNLDSNGNVSVLRTDQENNNNNNGTSGSFATLLNQLPQTPSLPQIDGLLRTPYQIQGTNWYG

SEQ ID NO: 795 - protein, 323 aa, Medicago truncatula
  misc_feature (1)..(323): Public GI ID no.87241197
  misc_feature (1)..(323): Bit score of 530.4 for HMM based on sequences of FIGURE 7.
  misc_feature (14)..(142): Pfam Name: NAM Pfam Description: No apical meristem (NAM) protein
  misc_feature (1)..(323): Functional Homolog Of Ceres CLONE ID no. 21243 at SEQ ID NO. 342
MEGQQNGSKSNYTFPPGFRFHPSDEELIVHYLQNKIKSRPLPASIIAEIDLYKYNPWELPKKSLFGEEEWYFFSPRDRKYPNGLRPNRTAASGYWKATGTDKPIISSCESKHIGVKKALVFYSGRPPKGVKTDWIMNEYRLVDTTAKSFKLKGSMRLDDWVLCRVRNKGYSLKNLSENQENPSEPTIPLNLPRGEERPTNVNLRSDIITDYQFKDYQIIASILVGGVIPPTENMSSLSVNGSKFNNLNSVSEEGFNKANSQTTNYSLECYFNPLKRKSNEDDDQFENLISFNSKFNSENKLCESPSIDFQKLNKFTFTERYQQ

SEQ ID NO: 796 - protein, 307 aa, Capsicum annuum
  misc_feature (1)..(307): Public GI ID no.57233056
  misc_feature (1)..(307): Bit score of 566.0 for HMM based on sequences of FIGURE 7.
  misc_feature (13)..(138): Pfam Name: NAM Pfam Description: No apical meristem (NAM) protein
  misc_feature (1)..(307): Functional Homolog Of Ceres CLONE ID no. 21243 at SEQ ID NO. 342
MIKGIVGNQQLGLPAGFRFHPTDEELVQHYLCRKCAGQSISVSIIAEIDLYKFDPWQLPEKALYGEKEWYFFSQEDRKYPNGSRPNRAAGTGYWKATGADKPVGKPKTLGIKKALVFYAGKAPRGIKTNWIMHEYRLANVDRSAGKSNNLRLDDWVLCRIYNKKGHTLRSITMWASKRGESFGEFEDEIKPKIFPTQLAPAPGQWPPRPQSTPASDYFNFETSESMTTTRMHTTNSSSGSEHVLSSCDKEVQSAPKWDDLGTAALDFQINYLDGLLNDPFEIQMQQQNCNIDQFNTFQDMFLYMQKP

SEQ ID NO: 797 - protein, 355 aa, Solanum lycopersicum
  misc_feature (1)..(355): Public GI ID no.52353036
  misc_feature (1)..(355): Bit score of 630.4 for HMM based on sequences of FIGURE 7.
  misc_feature (16)..(144): Pfam Name: NAM Pfam Description: No apical meristem (NAM) protein
  misc_feature (1)..(355): Functional Homolog Of Ceres CLONE ID no. 21243 at SEQ ID NO. 342
MESTDSSTGTRHQPQLPPGFRFHPTDEELIVHYLKKRVAGAPIPVDIIGEIDLYKFDPWELPAKAIFGEQEWFFFSPRDRKYPNGARPNRAATSGYWKATGTDKPVFTSGGTQKVGVKKALVFYGGKPPKGVKTNWIMHEYRVVENKTNNKPLGCDNIVANKKGSLRLDDWVLCRIYKKNNTQRSIDDLHDMLGSIPQNVPNSILQGIKPSNYGTILLENESNMYDGIMNNTNDIINNNNRSIPQISSKRTMHGGLYWNNDEATTTTTTIDRNHSPNTKRFLVENNEDDGLNMNNISRITNHEQSSSIANFLSQFPQNPSIQQQQQQQEEVLGSLNDGVVFRQPYNQVTGMNWYS

SEQ ID NO: 798 - protein, 304 aa, Petunia x hybrida
  misc_feature (1)..(304): Public GI ID no.21105748
  misc_feature (1)..(304): Bit score of 621.8 for HMM based on sequences of FIGURE 7.
  misc_feature (8)..(133): Pfam Name: NAM Pfam Description: No apical meristem (NAM) protein
  misc_feature (1)..(304): Functional Homolog Of Ceres CLONE ID no. 21243 at SEQ ID NO. 342
MTTAELQLPPGFRFHPTDEELVMHYLCRKCASQPIAVPIIAEIDLYKYDPWDLPDLALYGEKEWYFFSPRDRKYPNGSRPNRAAGTGYWKATGADKPIGHPKAVGIKKALVFYAGKAPKGEKTNWIMHEYRLADVDRSARKNNNSLRLDDWVLCRIYNKKGSIEKNQLNNKKIMNTSYMDMTVSSEEDRKPEILPPLPPQPAPQQQQVYNDFFYLDPSDSVPKIHSDSSCSEHVVSPEFTCEREVQSEAKLSEWEKAALDLPFNYMDATTGATTLDNSLLGSQFQSSYQMSPLQDMFMHLHKPF

SEQ ID NO: 799 - protein, 316 aa, Oryza sativa
  misc_feature (1)..(316): Public GI ID no.6730938
  misc_feature (1)..(316): Bit score of 559.6 for HMM based on sequences of FIGURE 7.
  misc_feature (19)..(147): Pfam Name: NAM Pfam Description: No apical meristem (NAM) protein
  misc_feature (1)..(316): Functional Homolog Of Ceres CLONE ID no. 21243 at SEQ ID NO. 342
MAAAVGGSGRRDAEAELNLPPGFRFHPTDEELVVHYLCRKVARQPLPVPIIAEVDLYKLDPWDLPEKALFGRKEWYFFTPRDRKYPNGSRPNRAAGRGYWKATGADKPVAPKGSARTVGIKKALVFYSGKAPRGVKTDWIMHEYRLADADRAPGGKKGSQKLDEWVLCRLYNKKNNWEKVKLEQQDVASVAAAAPRNHHHQNGEVMDAAAADTMSDSFQTHDSDIDNASAGLRHGGCGGGGFGDVAPPRNGFVTVKEDNDWFTGLNFDELQPPYMMNLQHMQMQMVNPAAPGHDGGYLQSISSPQMKMWQTILPPF

SEQ ID NO: 800 - protein, 296 aa, Saccharum officinarum
  misc_feature (1)..(296): Public GI ID no.58013003
  misc_feature (1)..(296): Bit score of 581.9 for HMM based on sequences of FIGURE 7.
  misc_feature (10)..(135): Pfam Name: NAM Pfam Description: No apical meristem (NAM) protein
  misc_feature (1)..(296): Functional Homolog Of Ceres CLONE ID no. 21243 at SEQ ID NO. 342
MSGGGQDLQLPPGFRFHPTDEELVMHYLCRRCASLPIAVPIIAEIDLYKFDPWQLPRMALYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGLEKPAAASSGDHKPMVFAAGAVSSPPEQKPFVATPGGLPPAAFTADLAAYYDRPSDSMPRLHADSSCSEQVLSPEQLACDREVQSQPKISEWERTFASDPVNPAGSMLVDPVVGGHAGDPLLQDILMYWGKPF

SEQ ID NO: 801 - protein, 359 aa, Triticum aestivum
  misc_feature (1)..(359): Public GI ID no.66275774
  misc_feature (1)..(359): Bit score of 592.3 for HMM based on sequences of FIGURE 7.
  misc_feature (13)..(141): Pfam Name: NAM Pfam Description: No apical meristem (NAM) protein
  misc_feature (1)..(359): Functional Homolog Of Ceres CLONE ID no. 21243 at SEQ ID NO. 342
MPMGSSSAAMPALPPGFRFHPTDEELIVHYLGRQAASMPSPVPIIAEVNIYKCNPWDLPGKALFGENEWYFFSPRDRKYPNGARPNRAAGSGYWKATGTDKAILSTPANESIGVKKALVFYRGKPPKGVKTDWIMHEYRLTAADNRTTKRRGSSMRLDDWVLCRIHKKCNNLHNFSSSDQEQEHEQESSTTVEDSHNNHTVSSPKSEAFDGDGDDQLQLQQFRPMAIAKSCSLTDLLNTVDYAALSHLLLDGAGAGASSSDAGADYQLPPENPLIYSQPPWQQTLHYNNNNNGYVNIDTIDVPQIPEARVDDYGMNGDRYNGMKRKRSSGSLYCSQLQLPADQYSGMLIHPFLSQQLHM

SEQ ID NO: 802 - protein, 355 aa, Triticum aestivum
  misc_feature (1)..(355): Public GI ID no.66275772
  misc_feature (1)..(355): Bit score of 593.1 for HMM based on sequences of FIGURE 7.
  misc_feature (13)..(141): Pfam Name: NAM Pfam Description: No apical meristem (NAM) protein
  misc_feature (1)..(355): Functional Homolog Of Ceres CLONE ID no. 21243 at SEQ ID NO. 342
MPMGSSSAAMPALPPGFRFHPTDEELIVHYLGRQAASMPSPVPIIAEVNIYKCNPWDLPGKALFGENEWYFFSPRDRKYPNGARPNRAAGSGYWKATGTDKAILSTPANESIGVKKALVFYRGKPPKGVKTDWIMHEYRLTAADNRTTKRRGSSMRLDDWVLCRIHKKCGNLPNFSSSDQEQEHEQESSTVEDSQNNHTVSSPKSEAFDGDGNDHLQLQQFRPMAIAKSCSLTDLLNTVDYAALSHLLLDGAGASSSDAGADYQLPPENPLIYSQPPWQQTLHYNNNNGYVNNETIDVPQLPEAGVDDYGMNGDKYNGMKRKRSSGSLYCSQLQLPADQYSGMLTHPFLSQQLHM

SEQ ID NO: 803 - protein, 354 aa, Triticum aestivum
  misc_feature (1)..(354): Public GI ID no.51702424
  misc_feature (1)..(354): Bit score of 587.6 for HMM based on sequences of FIGURE 7.
  misc_feature (12)..(140): Pfam Name: NAM Pfam Description: No apical meristem (NAM) protein
  misc_feature (1)..(354): Functional Homolog Of Ceres CLONE ID no. 21243 at SEQ ID NO. 342
MPMGSSAAMPALPPGFRFHPTDEELIVHYLRRQAASMPSPVPIIAEVNIYKCNPWDLPGKALFGENEWYFFSPRDRKYPNGARPNRAAGSGYWKATGTDKAILSTPANESIGVKKALVFYRGKPPKGVKTDWIMHEYRLTAADNRTTKRRGSSMRLDDWVLCRIHKKCGNLPNFSSSDQEQEHEQESSTVEDSQNNHTVSSPKSEAFDGDGDDHLQLQQFRPMAIAKSCSLTDLLNTVDYAALSHLLLDGAGASSSDAGADYQLPPENPLIYSQPPWQQTLHYNNNNGYVNNETIDVPQLPEARVDDYGMNGDKYNGMKRKRSSGSLYCSQLQLPADQYSGMLIHPFLSQQLHM

SEQ ID NO: 804 - protein, 396 aa, Triticum turgidum subsp. durum
  misc_feature (1)..(396): Public GI ID no.115336267
  misc_feature (1)..(396): Bit score of 685.0 for HMM based on sequences of FIGURE 7.
  misc_feature (28)..(157): Pfam Name: NAM Pfam Description: No apical meristem (NAM) protein
  misc_feature (1)..(396): Functional Homolog Of Ceres CLONE ID no. 21243 at SEQ ID NO. 342
MGSSDSSSGSAPPRHQPPPPQQGSAPELPPGFRFHPTDEELVVHYLKKKAAKVPLPVTIITEVDLYKFDPWELPEKATFGEQEWYFFSPRDRKYPNGARPNRAATSGYWKATGTDKPILASGCGREKVGVKKALVFYRGKPPKGLKTNWIMHEYRLTDASSSATTSRPPPVTGGSRSASLRLDDWVLCRIYKKINKAAAGDQQRSMECEDSVEDAVTAYPLYATAGMTGAGAHGSNYDSLLHHQDSHEDNFLDGLLTAEDAGLSAGPTSLSHLAAAARASPAPTKQFLAPSSSTPFNWLDASTVGILPQARNFPGFNRSRNVGNMSLSSTADMAVDNGGGNAINTMPPFMNHLPMQDGTYHQQHVILGAPLAPEATAAATSAFQHPVQISGVNWNP

SEQ ID NO: 805 - protein, 339 aa, Cymbidium hybrid
  misc_feature (1)..(339): Public GI ID no.117586720
  misc_feature (1)..(339): Bit score of 631.2 for HMM based on sequences of FIGURE 7.
  misc_feature (8)..(134): Pfam Name: NAM Pfam Description: No apical meristem (NAM) protein
  misc_feature (1)..(339): Functional Homolog Of Ceres CLONE ID no. 21243 at SEQ ID NO. 342
MSTSSVHLPPGFRFHPTDEELILHYLRNRAASSPCPASIIAEVDIYKFDPWDLPEKAAFGDREWYFFTPRDRKYPNGNRPNRAAGSGYWKATGTDKPISSGSENIGVKKALVFYKGRPPKGLKTNWIMHEFRLADANKSNSYKPIRLRDHSMRLDDWVLCRIYRKSNHLSPTEMDQEQEDPCGEETCFPAMQNQMMPMNHGMKLQKVSSISEFLQEYSPLLNLFDNQQEIPRFDSNSLLGHPLLSQSMINQNQDSGGNGYFLPQLSQAESPVSIGAKRQRMDDCTNEESNGTSHSSKKQNDLNMFPNFSSQFDGSQYGLLSQPFFSQQLLMNSNTGSLH

SEQ ID NO: 806 - protein, 357 aa, Zinnia elegans
  misc_feature (1)..(357): Public GI ID no.73759951
  misc_feature (1)..(357): Bit score of 480.2 for HMM based on sequences of FIGURE 7.
  misc_feature (11)..(140): Pfam Name: NAM Pfam Description: No apical meristem (NAM) protein
  misc_feature (1)..(357): Functional Homolog Of Ceres CLONE ID no. 21243 at SEQ ID NO. 342
MDTMNQSSCTVPPGFRFHPTDEELVGYYLRKKVASQKIDLDVIKDIDLYRIEPWDLIERCRIGYEEQNEWYFFSHKDKKYPTGTRTNRATMAGFWKATGRDKAVYEKLRLIGMRKTLVFYKGRAPNGQKTDWIMHEYRLESEENGPPQEEGWVVCRAFKKRATGQTRTTPAWESNYFLDESSLLTSTMDDYTTIQPSNIPLTSSFMCKQELEASENLNFIHCDQFIQLPHLESPSLQSIKRPISSILYEHDQQEDDQITKRITNNVRSKDEVRDWRDLDKFVASQLSQEEEIRCVEEGFSTNFQENIDHSTSLSHMFNYQDGIEEYSGCDKGGKLNGFLSSTSSDHFDVGICIFDKL

SEQ ID NO: 807 - protein, 383 aa, Aegilops tauschii
  misc_feature (1)..(383): Public GI ID no.115336269
  misc_feature (1)..(383): Bit score of 664.4 for HMM based on sequences of FIGURE 7.
  misc_feature (28)..(157): Pfam Name: NAM Pfam Description: No apical meristem (NAM) protein
  misc_feature (1)..(383): Functional Homolog Of Ceres CLONE ID no. 21243 at SEQ ID NO. 342
MGSSDSSSGSAPPRHQPPPPQQGSAPELPPGFRFHPTDEELVVHYLKKKAAKVPLPVTIIAEVDLYKFDPWELPEKATFGEQEWYFFSPRDRKYPNGARPNRAATSGYWKATGTDKPIMASGCGREKVGVKKALVFYRGKPPKGLKTNWIMHEYRLTDASSSATTSRPPPVTGGSRAASLRLDDWVLCRIYKKINKAAAGDQQRSMECEDSVEDAVTAYPPYATAGMTGAGAHGSNYDSLLHHQDSHEDNFLDGLLTAEDAGLSAGATSLSHLAAAARASPAPTKQFLAPSSSTPFNWLDASTVGILPQARNFPGFNRSRNVGNMSLSSTADMAVDNGGGNAINAMPPFMNHLPVQDGTYHQQHVILGAPLAPEATAAATSAF

SEQ ID NO: 808 - DNA, 1434 bp, Panicum virgatum
  misc_feature (1)..(1434): Ceres CLONE ID no.1824711
  misc_feature (1)..(1434): Encodes the peptide sequence at SEQ ID NO 809
attttttttttcaagactcatgcttgccttctatctaagcactactcctcctagttaattagctagtagcatctctcatctcctcctcccttcttgaggctccgatctatacagtagctagtagtcaacagtagtataaactgtgtgtagtagtagactgttgtgtagaggttgctacagagcaatccaacagctagcacatcagagctgagcagtcaccattgtttatcagtcgccatgacgagctcgactagactgcctaatcttccagctgggttccgcttccaccccacagatgaggagctcatcgtccactacctcatgaaccaagcttcctccatcccatgccctgtccccatcatcgccgaggtcaacatctaccagtgcaacccatgggatcttcctgccaaagctttgtttggagagaacgagtggtacttcttcagcccgagggatcgcaagtaccccaacggcgcccgccccaaccgcgccgccggatccggctactggaaggccaccggcaccgacaaggccatcctgttgactccgacgagcgagaacatcggagtcaagaaggcccttgtgttctacggcggtaagcctcccaagggtgtcaagacagactggatcatgcacgagtaccgcctcacaggagctaacaagaacaccaagcgtagaggatcctccatgaggctggacgactgggtcctctgcaggatccacaagaagagcaacaattttcagttgtctgatcaggaccaggaaggctccactgtggaggaagaatccctcaacaacaagatgaatggcacaattacagcctcgcccaagtctgaagccaataatgatggtcatgatcatcagttccatccgacgacgatggccatgaacaaatcatactcaatcaccgatctcctcaacaccatcgactactcggcgctctcgcagctcctcgatgccccagctgaacctgaaccaccgctaatctacccaacaacaacacaaacacatcacgaagcactacttaactataacaacaacgtgaacaatagccacttcaatatgccacaagtagacgcatattcagatcatgttgcgactaattgcaacggtctgaagaggaagcgagtgatgactatggatggtgctgaatcctccttcgacgatgatggcagcagtaacttcagtagaaaactactgaagctgccaagtgattcacggagcagcagccacagccattttggcagcacgacgagcagctactgcaaccagcagcttgtggacacgagtggttttcagcacagcagcctgctgagctatccattcctcgagatgcagtagtatctatgtagtattacaccgagagcttggtgtgaatgaattcatacagctgaaacttcgactgggtcaaattaaaaaaaaaaaaaaaaaaaa

SEQ ID NO: 809 - protein, 367 aa, Panicum virgatum
  misc_feature (1)..(367): Ceres CLONE ID no.1824711
  misc_feature (1)..(367): Bit score of 677.2 for HMM based on sequences of FIGURE 7.
  misc_feature (10)..(138): Pfam Name: NAM Pfam Description: No apical meristem (NAM) protein
  misc_feature (1)..(367): Functional Homolog Of Ceres CLONE ID no. 21243 at SEQ ID NO. 342
MTSSTRLPNLPAGFRFHPTDEELIVHYLMNQASSIPCPVPIIAEVNIYQCNPWDLPAKALFGENEWYFFSPRDRKYPNGARPNRAAGSGYWKATGTDKAILLTPTSENIGVKKALVFYGGKPPKGVKTDWIMHEYRLTGANKNTKRRGSSMRLDDWVLCRIHKKSNNFQLSDQDQEGSTVEEESLNNKMNGTITASPKSEANNDGHDHQFHPTTMAMNKSYSITDLLNTIDYSALSQLLDAPAEPEPPLIYPTTTQTHHEALLNYNNNVNNSHFNMPQVDAYSDHVATNCNGLKRKRVMTMDGAESSFDDDGSSNFSRKLLKLPSDSRSSSHSHFGSTTSSYCNQQLVDTSGFQHSSLLSYPFLEMQ

SEQ ID NO: 810 - protein, 303 aa, Elaeis guineensis
  misc_feature (1)..(303): Public GI ID no.82400207
  misc_feature (1)..(303): Bit score of 608.1 for HMM based on sequences of FIGURE 7.
  misc_feature (14)..(142): Pfam Name: NAM Pfam Description: No apical meristem (NAM) protein
  misc_feature (1)..(303): Functional Homolog Of Ceres CLONE ID no. 21243 at SEQ ID NO. 342
MGSRRRDAEAELNLPPGFRFHPTDEELVVHYLCKKVACQRLPVPIIAEVDLYKYDPWDLPEKALFGLKEWYFFTPRDRKYPNGSRPNRAAGRGYWKATGADKPVTPKGSSRPLGIKKALVFYSGKAPRGVKTDWIMHEYRLADTNRAANKKGSLRLDDWVLCRLYNKKNTWEKMQQQKEAASFGETMDSVDDTGSDSFRTPESDIDNDVMFPDFDDMAQVGAHPPQAFNGMQGVRVNNITGYQPAIEQRPKEENDWFTDLNLDDFHSTCMAFGSTPALDMSDHDYYYSNLPQLRSNQSDLLPF

SEQ ID NO: 811 - protein, 303 aa, Elaeis guineensis
  misc_feature (1)..(303): Public GI ID no.82400213
  misc_feature (1)..(303): Bit score of 595.2 for HMM based on sequences of FIGURE 7.
  misc_feature (14)..(142): Pfam Name: NAM Pfam Description: No apical meristem (NAM) protein
  misc_feature (1)..(303): Functional Homolog Of Ceres CLONE ID no. 21243 at SEQ ID NO. 342
MGSRRRDAEAELNLPPGFRFHPTDEELVVHYLCKKVACQRLPVPIIAEVDLYKYDPWDLPEKALFGLKEWYFFTPRDRKYPNGSRPNRAAGRGYWKATGADKPVTPKGSSRPLGIKKALVFYSGKAPRGVKTDWIMHEYRLADTNRAANKKGSLRLDDWVLYRLYNKKNTWEKMQQQKEAASFGETMDSVDDTGSDSFRTPESDIDNDVMFPDFDDMAQVGAHPPQAFNGMQGVRVNNITGYQPAIEQRPKEENDWFTDLNLDDFHSTCMAFGSTPALDMSDHDYYYSNLPQLRSNQSDLLPF

SEQ ID NO: 812 - protein, 335 aa, Elaeis guineensis
  misc_feature (1)..(335): Public GI ID no.82400209
  misc_feature (1)..(335): Bit score of 568.4 for HMM based on sequences of FIGURE 7.
  misc_feature (14)..(142): Pfam Name: NAM Pfam Description: No apical meristem (NAM) protein
  misc_feature (1)..(335): Functional Homolog Of Ceres CLONE ID no. 21243 at SEQ ID NO. 342
MGSRRRDAEAELNLPPGFRFHPTDEELVVHYLCKKVACQRLPVPIIAEVDLYKYDPWDLPEKALFGLKEWYFFTPRDRKYPNGSRPNRAAGRGYWKATGADKPVTPKGSSRPLGIKKALVFYSGKAPRGVKTDWIMHEYRLADTNRAANKKGSLRVCHRQSEIHKFFGFLGFFMNIDSDEKIHEFMQLDDWVLCRLYNKKNTWEKMQQQKEAASFGETMDSVDDTGSDSFRTPESDIDNDVMFPDFDDMAQVGAHPPQAFNGMQGVRVNNITGYQPAIEQRPKEENDWFTDLNLDDFHSTCMAFGSTPALDMSDHDYYYSNLPQLRSNQSDLLPF

SEQ ID NO: 813 - protein, 303 aa, Avicennia marina
  misc_feature (1)..(303): Public GI ID no.154362215
  misc_feature (1)..(303): Bit score of 631.4 for HMM based on sequences of FIGURE 7.
  misc_feature (10)..(135): Pfam Name: NAM Pfam Description: No apical meristem (NAM) protein
  misc_feature (1)..(303): Functional Homolog Of Ceres CLONE ID no. 21243 at SEQ ID NO. 342
MKGGDQQLNLPAGFRFHPTDEELVVHYLCRKCAGQQIGVPVIAEIDLYKFDPWELPDLALYGEKEWYFFSPRDRKYPNGSRPNRAAGTGYWKATGADKPVGKPKTLGIKKALVFYAGKAPRGVKTNWIMHEYRLANVDRSAGKTKNLRLDDWVLCRIYNKKGTLEKHLSVDQKEVQFSDSEEQKPEVDAFPFGDMVMPGPAPPVQAPVTLASQRMNDYMHFDASDSFPKLHTDSSSSEHVLSPEFMCDKEVQSAPKWSELESTLDFPLIYMDGFQDDPFGSQMQYGDQLSLFPDMYAYMQKPF

SEQ ID NO: 814 - protein, 283 aa, Thellungiella halophila
  misc_feature (1)..(283): Public GI ID no.78499704
  misc_feature (1)..(283): Bit score of 434.1 for HMM based on sequences of FIGURE 7.
  misc_feature (10)..(139): Pfam Name: NAM Pfam Description: No apical meristem (NAM) protein
  misc_feature (1)..(283): Functional Homolog Of Ceres CLONE ID no. 21243 at SEQ ID NO. 342
MGLDQESSSVPPGFRFHPTDEELVGYYLKKKVASQKIDLDVIREIDLYKIEPWDLQERCKIGYEQKEWYFFSHKDKKYPTGTRTNRATVAGFWKATGRDKAVYLNSKLIGMRKTLVFYRGRAPNGQKSDWIIHEYYSLESHQNYSPPQEEGWVVCRAFKKRSTVPTKRRQRLWDPNCFFYDATLLEPLDKNVLKRAKHNTDFAVTVPFKHIVDDEDLGSMHLHSIDDDQFSQLPQLESPSLPSDKLPEMARQSTRALEDEKRITDWRSLDKFVATQFLMSGQD

SEQ ID NO: 815 - protein, 295 aa, Prunus mume
  misc_feature (1)..(295): Public GI ID no.82568708
  misc_feature (1)..(295): Bit score of 629.2 for HMM based on sequences of FIGURE 7.
  misc_feature (8)..(133): Pfam Name: NAM Pfam Description: No apical meristem (NAM) protein
  misc_feature (1)..(295): Functional Homolog Of Ceres CLONE ID no. 21243 at SEQ ID NO. 342
MSSSDLQLPPGFRFHPTDEELVKHYLCRKCQSQPISVPIIAEIDLYKYNPWDLPGLALYGEKEWYFFSPRDRKYPNGSRPNRAAGSGYWKATGADKPIGSPKPVGIKKALVFYAGKAPRGEKTNWIMHEYRLADVDRSPRKKSSSLRLDDWVLCRIYNKKGTVEKQQQQQQQQQQQTTSRMSSGSEFEDRKPENLACPPPPAAVAPTRPNDYVYFDTSDSVPRLHTDSSCSEHVVSPEFTCEVQSEPKWKEWEKALDFNYNYMDTSVENGFGPQFQSANQMSPLQDIFMYLQKPY

SEQ ID NO: 816 - protein, 144 aa, Pinus taeda
  misc_feature (1)..(144): Public GI ID no.54634694
  misc_feature (1)..(144): Bit score of 400.3 for HMM based on sequences of FIGURE 8.
  misc_feature (41)..(144): Pfam Name: p450 Pfam Description: Cytochrome P450
  misc_feature (1)..(144): Functional Homolog Of Ceres CLONE ID no. 41046 at SEQ ID NO. 342
MGSEVLAQGSALLEKSLIALLVVVVGAVLVNKLRGRKLKLPPGPFALPIFGNWLQVGDDLNHRNLTDLAKKYGKIFLLKMGQRNLVVVSSPDLAKEVLHTQGVEFGSRTRNVVFDIFTGKGQDMVFTVYGDHWRKMRRIMTVPF

SEQ ID NO: 817 - protein, 144 aa, Pinus taeda
  misc_feature (1)..(144): Public GI ID no.54634766
  misc_feature (1)..(144): Bit score of 399.2 for HMM based on sequences of FIGURE 8.
  misc_feature (41)..(144): Pfam Name: p450 Pfam Description: Cytochrome P450
  misc_feature (1)..(144): Functional Homolog Of Ceres CLONE ID no. 41046 at SEQ ID NO. 342
MGSEVLAQGSALLEKSLIALLVVVVGAVLVNKLRGRKLKLPPGPFALPIFGNWLQVGDDLNHRNLSDLAKKYGKIFLLKMGQRNLVVVSSPDLAKEVLHTQGVEFGSRTRNVVFDIFTGKGQDMVFTVYGDHWRKMRRIMTVPF

SEQ ID NO: 818 - protein, 144 aa, Pinus taeda
  misc_feature (1)..(144): Public GI ID no.54634678
  misc_feature (1)..(144): Bit score of 395.5 for HMM based on sequences of FIGURE 8.
  misc_feature (41)..(144): Pfam Name: p450 Pfam Description: Cytochrome P450
  misc_feature (1)..(144): Functional Homolog Of Ceres CLONE ID no. 41046 at SEQ ID NO. 342
MGSEVLAQGSALLEKFLIALLVVVVGAVLVNKLRGRKLKLPPGPFALPIFGNWLQVGDDLNHRNLTDLAKKYGKIFLLKMGQRNLVVVSSPDLAKEVLHTQGVEFGSRTRNVVFDIFTGKGQDMVFTVYGDHWRKMRRIMTVPF

SEQ ID NO: 819 - protein, 144 aa, Pinus taeda
  misc_feature (1)..(144): Public GI ID no.54634702
  misc_feature (1)..(144): Bit score of 394.3 for HMM based on sequences of FIGURE 8.
  misc_feature (41)..(144): Pfam Name: p450 Pfam Description: Cytochrome P450
  misc_feature (1)..(144): Functional Homolog Of Ceres CLONE ID no. 41046 at SEQ ID NO. 342
MGSEVLAQGSALLEKFLIALLVVVVGAVLVNKLRGRKLKLPPGPFALPIFGNWLQVGDDLNHRNLSDLAKKYGKIFLLKMGQRNLVVVSSPDLAKEVLHTQGVEFGSRTRNVVFDIFTGKGQDMVFTVYGDHWRKMRRIMTVPF

SEQ ID NO: 820 - protein, 174 aa, Pinus pinaster
  misc_feature (1)..(174): Public GI ID no.38322956
  misc_feature (1)..(174): Bit score of 388.0 for HMM based on sequences of FIGURE 8.
  misc_feature (37)..(171): Pfam Name: p450 Pfam Description: Cytochrome P450
  misc_feature (1)..(174): Functional Homolog Of Ceres CLONE ID no. 41046 at SEQ ID NO. 342
MEIMTVASLEKGLLAIFAVIVGAIFISKLKSKKLKLPPGPLAVPVFGNWLQVGDDLNHRNLGDLAKKYGEIFLLKMGQRNLVVVSSPELAKEVLHTQGVEFGSRTRNVVFDIFTGKGQDMVFTVYGEHWRKMRRIMTVPFFTNKVVQQYRFAWEDELGRAVDDIKKRPEASTTG

What is claimed is:

1. A method of increasing lignin content in a plant, said method comprising: a) introducing into a plant cell an isolated nucleic acid comprising a regulatory region operably linked to a polynucleotide encoding a lignin-modulating polypeptide comprising an amino acid sequence having 95% or greater sequence identity to the amino acid sequence set forth in SEQ ID NO:149, said polypeptide having a nicotinamide adenine dinucleotide (NAD)-dependent epimerase/dehydratase domain; and b) selecting a plant produced from said plant cell that has at least a 35% increase in lignin content in a tissue of the plant as compared to the lignin content in tissue of a corresponding control plant that does not comprise said nucleic acid.

2. The method of claim 1, wherein said plant cell is capable of producing one or more lignin monomers.

3. The method of claim 1, wherein said plant is from a genus selected from the group consisting of *Agrostis, Avena, Festuca, Hordeum, Lolium, Medicago, Milium, Miscanthus, Panicum, Poa, Saccharum, Sorghum, Trifolium, Triticum,* and *Zea*.

4. The method of claim 1, wherein said plant is a species selected from the group consisting of: a *Miscanthus×giganteus* hybrid, *Miscanthus sinensis, Miscanthus sacchariflorus, Panicum virgatum, Populus balsamifera, Sorghum almum, Sorghum halepense, Sorghum vulgare,* and *Saccharum* spp.

5. The method of claim 1, wherein said regulatory region is a promoter.

6. The method of claim 5, wherein said promoter is a lignin or cellulose biosynthesis promoter.

7. The method of claim 6, wherein said promoter is selected from the group consisting of SEQ ID NOs:345-354.

8. The method of claim 5, wherein said promoter is a tissue-preferential promoter.

9. The method of claim 8, wherein said tissue is secondary cell wall, vascular, stem, pith, xylem, phloem, root, tuber, or leaf tissue.

10. The method of claim 5, wherein said promoter is a cell type-preferential promoter.

11. The method of claim 10, wherein said cell is a sieve, laticifer, companion, sclerenchyma, or xylem cell.

12. The method of claim 5, wherein said promoter is an inducible promoter.

13. The method of claim 1, wherein said plant is from a genus selected from the group consisting of *Eucalyptus, Oryza, Pinus, Populus, Prunus,* and *Quercus*.

14. The method of claim 1, wherein said method further comprises introducing into said plant cell a nucleic acid encoding a second lignin-modulating polypeptide operably linked to a second regulatory region.

15. The method of claim 14, wherein said nucleic acid encoding a second lignin-modulating polypeptide operably linked to a second regulatory region is present on a second recombinant nucleic acid construct.

16. A plant produced by the method of claim 1.

17. Progeny of the plant of claim 16, wherein said progeny comprises the polynucleotide encoding the lignin-modulating polypeptide comprising an amino acid sequence having 95% or greater identity to the amino acid sequence set forth in SEQ ID NO: 149, said polypeptide having a NAD-dependent epimerase/dehydratase domain, and wherein tissue of said progeny has at least a 35% increase in lignin content as compared to the lignin content in tissue of a corresponding control plant that does not comprise said nucleic acid.

18. The progeny of claim 17, wherein said progeny is from a genus selected from the group consisting of *Agrostis, Avena, Festuca, Hordeum, Lolium, Medicago, Milium, Miscanthus, Panicum, Poa, Saccharum, Sorghum, Trifolium, Triticum,* and *Zea*.

19. The progeny of claim 18, wherein said progeny is a species selected from the group consisting of: a *Miscanthus× giganteus* hybrid, *Miscanthus sinensis, Miscanthus sacchariflorus, Panicum virgatum, Populus balsamifera, Sorghum almum, Sorghum halepense, Sorghum vulgare,* and *Saccharum* spp.

* * * * *